United States Patent 8,299,318 (NUCLEOTIDE SEQUENCES AND CORRESPONDING POLYPEPTIDES CONFERRING MODULATED PLANT CHARACTERISTICS) - sequence listing, part 16

SEQ ID NO: 49458 - protein, 133 aa, Panicum virgatum
  misc_feature: Ceres CLONE 2050023
  misc_feature (14)..(61): Pfam Name: Myb_DNA-binding Pfam Description: Myb-like DNA-binding domain
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1073 in the 10/374,780 US patent application
  misc_feature: The sequence is a functional homolog of SEQ ID NO 1004 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 569 in the 10/374,780 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 824 in the 10/412,699 US patent application
  misc_feature: The sequence is a functional homolog of SEQ ID NO 1002 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1010 in the 11/435,388 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 296 in the 11/479,226 US patent application
  misc_feature: The sequence is a functional homolog of SEQ ID NO 822 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 1681 in the 10/374,780 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 794 in the 11/435,388 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 58 in the 10/666,642 US patent application
  misc_feature: The sequence is a functional homolog of SEQ ID NO 790 in the 11/435,388 US patent application
  misc_feature: The sequence is a functional homolog of SEQ ID NO 442 in the 10/412,699 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 743 in the 10/666,642 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: Functional homolog of the protein sequence given in SEQ ID NO 50235
  misc_feature: Useful for biocontainment applications
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 796 in the 11/435,388 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 271 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1917 in the 10/374,780 US patent application
  misc_feature: Functional homolog of the protein sequence given in SEQ ID NO 50238
  misc_feature: Useful for making plants with altered terpenoid content
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
MGRAPCCEKVGLKKGRWTKEEDEILARYIKEHGEGSWRSLPKNAGLLRCGKSCRLRWINYLRADLKRGNISEEEEEMIIKLHATLGNRCASIRHSARLPQLLGICVQTRSCAFFYYSCIRRNLVALNICRTAS

SEQ ID NO: 49459 - DNA, 707 bp, Panicum virgatum
  misc_feature: Ceres CLONE 2050031
  misc_feature: Encodes the peptide sequence at SEQ ID NO. 49460
  misc_feature (619)..(619): n is a, c, t, g, unknown, or other
actcccctctcgaaggcgaccgagaaagaactccagcagcagcagctctgtagcgtcagactcccctccttttccccgcgtctcctctgagctccggcgaaagcccgccgccgccgccgtggccggacttccgatggcaactcctcggaagccgatcaagctcaccctgccgtcccacgagaccgccataggcaaattcctgacgcaaagcgggacgttcagggacggggatctgctcgtcaacaaggatggcctccgtatcgtttcgcagaacgagggaggcgaggctcctcctatagagccactggataatcaattgagcttagatgatctagacgtaatcaaagtgatcgggaaaggtagcagtggaaatgtgcaattggtccgccacaaatttactgggcagttttttgctctgaaggttattcaactaaaaattgaggaaagtatgcgcaaacagattgccaaggagttgaaaataaacctgtcaacacagtgccaatatattgtcgtgttctatcagtgtttttatttcaacggtgccatttctattgttttggaatacatggatggtggctccctttcagatttcctgaagactgttaaaaccattcctgangactaccttgctgctatctgtaagcagatactaaaaggactggtgtacttgcatcatgagaggcgcattatacaccgagatcttaaac

SEQ ID NO: 49460 - protein, 191 aa, Panicum virgatum
  misc_feature: Ceres CLONE 2050031
  misc_feature: SWISSPROT Homolog: EC 2.7.12.2 Mitogen-activated protein kinase kinase
  misc_feature (162)..(162): Xaa is any aa, unknown, or other
MATPRKPIKLTLPSHETAIGKFLTQSGTFRDGDLLVNKDGLRIVSQNEGGEAPPIEPLDNQLSLDDLDVIKVIGKGSSGNVQLVRHKFTGQFFALKVIQLKIEESMRKQIAKELKINLSTQCQYIVVFYQCFYFNGAISIVLEYMDGGSLSDFLKTVKTIPXDYLAAICKQILKGLVYLHHERRIIHRDLK

SEQ ID NO: 49461 - DNA, 603 bp, Panicum virgatum
  misc_feature: Ceres CLONE 2050061
  misc_feature: Encodes the peptide sequence at SEQ ID NO. 49462
aaaaaaagctcctccattcacatctccccccctccccctcccccgtgaggtctctctcccatctcttcctccgatctcccccgcggccgccgccgccgcatgccgtccgaaccctagacccgtctacgcgcccattgcctccgatcgccatgtccgccgctcagctgttccgtcactcccgcaagctgcggagcttgcaaaatgctgtagattgcgagcattctagtcttgttcggtatttctctagcagttccggttcctttatcgtcaaggaaaatggtgttggaaagagaactggaggcaccagattatctaagcataggcagcctgcaaaagagcttgagacattctcagtgggagtaaacagaagctacacttggacaagagcatccaacagccgtatcccaagtgctgttaggggtctcaatggttcattttcatgtggacaggtggcttcagctcgaccattctcaagtagtgcagacttgccaccacatcaagaaatcgggatgccgtcactttcgcccacaatgactgagggaaacattgccaagtggcttaagaaggaaggagacaaggtctcccctggtgaggttctctgtg

SEQ ID NO: 49462 - protein, 151 aa, Panicum virgatum
  misc_feature: Ceres CLONE 2050061
  misc_feature: SWISSPROT Homolog: EC 2.3.1.12 Dihydrolipoyllysine-residue acetyltransferase
MSAAQLFRHSRKLRSLQNAVDCEHSSLVRYFSSSSGSFIVKENGVGKRTGGTRLSKHRQPAKELETFSVGVNRSYTWTRASNSRIPSAVRGLNGSFSCGQVASARPFSSSADLPPHQEIGMPSLSPTMTEGNIAKWLKKEGDKVSPGEVLC

SEQ ID NO: 49463 - DNA, 643 bp, Panicum virgatum
  misc_feature: Ceres CLONE 2050076
  misc_feature: Encodes the peptide sequence at SEQ ID NO. 49464
aacgcgtgacctcctcgtcgtcgtcttccgctctccttcccgactcctcgcgtgttgtctcctcttccacctccactcaactactgctcgcgaaccctagccgtgacccaatcaggaaccagccatggaggcgggggcgtcgccgccccggtcggtctccgtcggcggcggcggcggcttcggaggggcgcgcggcgacgacagcgccttctcgttcctctccaaggggtggcgcgaggtgcgggactccgccaccgccgacctgcgcctcatgcgcgcgcgggccgactccctccgcacgctcgcggaccgcgagctcgagcacctcctcgcgtccgcctccaccgcgctcgccgccgcgccgccgccgccgccgctcgccgcgggggcgcccatcgccgagctcgagttcgtgcgcacccggatccagcccaagatctccgagctgcggcgccggtacgcgtcgcgggagcgggacctcggccgccgggtgctcgagggctgggccccgggcgggcccgcccgcgcccgcgtcgacctctccgggatcaccgccatccgcaacgccatcgtctccgaggcggacggcggcgagcggtggaggcgcgccgcgtggaagggggaggcggaggaggggaaggag

SEQ ID NO: 49464 - protein, 172 aa, Panicum virgatum
  misc_feature: Ceres CLONE 2050076
  misc_feature: SWISSPROT Homolog: EC 2.4.1.241 Digalactosyldiacylglycerol synthase
MEAGASPPRSVSVGGGGGFGGARGDDSAFSFLSKGWREVRDSATADLRLMRARADSLRTLADRELEHLLASASTALAAAPPPPPLAAGAPIAELEFVRTRIQPKISELRRRYASRERDLGRRVLEGWAPGGPARARVDLSGITAIRNAIVSEADGGERWRRAAWKGEAEEGK

SEQ ID NO: 49465 - DNA, 667 bp, Panicum virgatum
  misc_feature: Ceres CLONE 2050099
  misc_feature: Encodes the peptide sequence at SEQ ID NO. 49466
gaggccacacgagaagacggaggcgagacggcgagcgccagagctctccctcaccctcccagggtcctcctccctccggcctccccctcctcctcgtcctctccctctcctcccaaaccaagaaggcagtgagaaccgaagcgcgcgccgagagggaggggagcctcgccgcctctcgcggcagatctcgcgccagccccgggttctgacgcgagatccgcgctcgccgcccgccggccggtgccgccgctgcccgctcgctcgcccgcccgatctcgaagaatccaccttgaagatgatgatgggtttgctagcgttcgagagtcaccaggggctctggaatagtggatactattcccagttgtttggaattgggggagttatgatcactgttgccattcttatgctatccacgggctactttggtgggatcggtgctccatttgctccgtatttctggccatatctaggacaagttccgaagaagagggaacgcaaaaggcctgtgagagtgtacatggatggatgctttgacctcatgcactatggtcatgcaaatgcgttgcgacaggccaaactgttgggagatcagctggtagttggggttgtcagtgatgaggagatcgtcgcaaataagggcccgcctgtcctttctatggaagagagg

SEQ ID NO: 49466 - protein, 123 aa, Panicum virgatum
  misc_feature: Ceres CLONE 2050099
  misc_feature: SWISSPROT Homolog: EC 2.7.7.14 Ethanolamine-phosphate cytidylyltransferase
MMMGLLAFESHQGLWNSGYYSQLFGIGGVMITVAILMLSTGYFGGIGAPFAPYFWPYLGQVPKKRERKRPVRVYMDGCFDLMHYGHANALRQAKLLGDQLVVGVVSDEEIVANKGPPVLSMEE

SEQ ID NO: 49467 - DNA, 549 bp, Panicum virgatum
  misc_feature: Ceres CLONE 2050117
  misc_feature: Encodes the peptide sequence at SEQ ID NO. 49468
tggctcagtctgcccggccgatgtgccgtggcaggccgcctcgaagctcccttcctcacgggcggcgatggggcggctgttcctgacgcacctggacggcaacgtctacagctgcaagcactgcaagacccacctcggccttgccagcgacatcatctccaaggccttccacagcaagaacgggaaggcctacctcttccataaggttgtcaatgtgactcctggagtaaaagaagaccgcatgatgataacaggaatgcatactgtttctgatatcttctgtgtttgctgtggatccattgttggatggaaatatgaagccgcacatgagaagaaccagaggtacaaggaaggaaagtatattctggagaggttcaaggtggcaggcccagacggaagccagtactggattgcacatgatgctcattcggtcggaagtgatgccgacgatatatgaagagggattgggcaagctcaagcatgttagtcatcccctgtaaataacttgggtggtgttggtctttagccagccggggattgctcccattg

SEQ ID NO: 49468 - protein, 129 aa, Panicum virgatum
  misc_feature: Ceres CLONE 2050117
  misc_feature (1)..(108): Pfam Name: Yippee Pfam Description: Yippee putative zinc-binding protein
MGRLFLTHLDGNVYSCKHCKTHLGLASDIISKAFHSKNGKAYLFHKVVNVTPGVKEDRMMITGMHTVSDIFCVCCGSIVGWKYEAAHEKNQRYKEGKYILERFKVAGPDGSQYWIAHDAHSVGSDADDI

SEQ ID NO: 49469 - DNA, 711 bp, Panicum virgatum
  misc_feature: Ceres CLONE 2050118
  misc_feature: Encodes the peptide sequence at SEQ ID NO. 49470
atctctccctcccatccctcccaccaaattcgcacagggcaggcggcgcatccggaatcccgctcccctcccaaaaccctagcggcttcctcccggcctcccaggccaatccgatcgactgccgccgcgcattggttgaggtttgactttgtactggccccaataatcaagatcgcatctccagttgaaggctcagcgattaaataactatctgactgcgtcattaatacactggtttggaactgcggcagaggctgtacatctcaactgaggaagctgggggtgtgaggcctgtaggccgttgcctgtggcatggcgaccgcgacaatggcaaccgcagcaggggctgccgccctgctttactatacactgaaccggcgtcttcagacagagagactgaatcaggaaggggaatgcagcaacagcagggatgtggtggccaggggtgtgccggattctcccagcaggagtcgggtttcacggagggatgtacgagcccctgctacttggctagagaccatctcaactctgtcagagacattgcggttcacgtattcggagacccttgggaagtggcccatcggtgaccttgcttttgggatcagcttcctcctcaagaggcagggaaacttatcagtagcaagcatatatgctgcaaatgatagtgtggagctcaaaggagctgaagtgattgctgacttgaagtatctt

SEQ ID NO: 49470 - protein, 127 aa, Panicum virgatum
  misc_feature: Ceres CLONE 2050118
  misc_feature (49)..(127): Pfam Name: Lipase3_N Pfam Description: Lipase 3 N-terminal region
MATAAGAAALLYYTLNRRLQTERLNQEGECSNSRDVVARGVPDSPSRSRVSRRDVRAPATWLETISTLSETLRFTYSETLGKWPIGDLAFGISFLLKRQGNLSVASIYAANDSVELKGAEVIADLKY

SEQ ID NO: 49471 - DNA, 683 bp, Panicum virgatum
  misc_feature: Ceres CLONE 2050132
  misc_feature: Encodes the peptide sequence at SEQ ID NO. 49472
agcatcgcgaaaaaatctttttctcgcctctcctcgctcctcgccgtttctctctcctcccctccgcctcacccgccgctcgccgcgaaatccacccgcggacgccgcccgctcgccgtggagagcctcggattagagtgcgccccgtcgagagatttcgaagcaactatgtttgggattgtttgatatgatacttgttcacgttgggggatgcagacccccccctctgtgggggttgattgaagaagttaacagtactcttagacgaacttgtgtcctactgatactgaaagtttcttggtttcgaggtgctcttatttctcactggagcagtttctgtagtttctttccttccctttgagagcctttctagtttcttgggcaggctcttgagctaccaaagtaccaagtatgtcagcttcaaatgagaagtggatcgatgggctccagttcacatcactgttctggcctccaccccaggatgtgcaacagaagcaggcacaaattttggcctatgttgagtactttggccagtttacagctgacagcgagcaattccctgaagatgtagcacagctcattcaaagttgctacccatggaaagaaaaacgcttggtagatgaagtgttggcaacttttgttcttcatcatcccgagcatggtcatgcagttgtacatccagt

SEQ ID NO: 49472 - protein, 90 aa, Panicum virgatum
  misc_feature: Ceres CLONE 2050132
  misc_feature: Functional homolog of the protein sequence given in SEQ ID NO 50888
  misc_feature: Useful for making plants with modulated flowering time
  misc_feature: Functional homolog of the protein sequence given in SEQ ID NO 50889
  misc_feature: Useful for making plants with modulated biomass
MSASNEKWIDGLQFTSLFWPPPQDVQQKQAQILAYVEYFGQFTADSEQFPEDVAQLIQSCYPWKEKRLVDEVLATFVLHHPEHGHAVVHP

SEQ ID NO: 49473 - DNA, 699 bp, Panicum virgatum
  misc_feature: Ceres CLONE 2050143
  misc_feature: Encodes the peptide sequence at SEQ ID NO. 49474
atatatatatatatatatccgccggcgcgccgcccgccggccacctccacctcgccggcgatatgctgacctgcggccgcttcctctcctcctccgcggccacaaccaccgcctccttctccccgctccggaccctcacccgctccctgctccgccggccccatccccgcctcctctcctccgcctccgccgccgccacgaccgccgtcgagcccgacaccaaaggtaagagctttagccttgattctttgattcattcgcagccagacatacaagcttggcttttggctgcaggaggcggcggcggcggcgcgggtggaggaggtggtggcgtcgtgaggccgcagtggaaggcggcgattgacttcaagtggatccgggacaaccgggacgccgtcgccgacaatatccggagcaggaactccgccgccaacctcgaccttgtcctcgagctgtacgaccagtacctcgcgctgcagaaggaggttgaacggctccgagctgaaagaaatgcagttgctaacaagatgaaagggaaactagatccatcagtgcgccaagcccttgttgaagaaggcaagaacctgaaagaggcgcttattggacttgaagaggatcttgttgagctgactgataagcttcaacttgaagcacagagtattcctaacgctacacatccagatgttcctgtaggcagtg

SEQ ID NO: 49474 - protein, 212 aa, Panicum virgatum
  misc_feature: Ceres CLONE 2050143
  misc_feature (99)..(204): Pfam Name: Seryl_tRNA_N Pfam Description: Seryl-tRNA synthetase N-terminal domain
  misc_feature: SWISSPROT Homolog: EC 6.1.1.11 Serine--tRNA ligase
MLTCGRFLSSSAATTTASFSPLRTLTRSLLRRPHPRLLSSASAAATTAVEPDTKGKSFSLDSLIHSQPDIQAWLLAAGGGGGGAGGGGGGVVRPQWKAAIDFKWIRDNRDAVADNIRSRNSAANLDLVLELYDQYLALQKEVERLRAERNAVANKMKGKLDPSVRQALVEEGKNLKEALIGLEEDLVELTDKLQLEAQSIPNATHPDVPVGS

SEQ ID NO: 49475 - DNA, 619 bp, Panicum virgatum
  misc_feature: Ceres CLONE 2050147
  misc_feature: Encodes the peptide sequence at SEQ ID NO. 49476
tcctgccgcgaaacctcttcgagcagttccggcggctgtcgtacgtctacttcctcgccatcaccgtgctcaaccagctgccccaggtcgccgtcttcggccgcggcgcgtccgtgctcccgctcgccttcgttctcttcgtcactgccgtgaaggacgcctacgaggacttccgccgccaccgttccgaccgccaggagaacaaccgccttgcctccgtgctcgcgccgggcaccgcgggcgatttcgagcccaagagatggaagcacatacgcgtaggggacgtggtgcgcgtggcgtccaacgagacgctcccggccgacatggcgctgctcgccaccagcgaccccactggcgtcgcccatgtccagacggtgaatctcgacggggagaccaacctcaagacgaggtatgccaagcaggagacgcaggtgaggttctcccagaatggtggtgtaggtggcatcctgcattgcgagcgaccaaacaggaacatctacggatttcaggcgaatttggatattgatgggaagcgtgtatcacttggaccatccaacattgtgcttcgtggttgtgaactcaagaacaccacgtgggcaataggggttgtggtatatgc

SEQ ID NO: 49476 - protein, 205 aa, Panicum virgatum
  misc_feature: Ceres CLONE 2050147
  misc_feature: SWISSPROT Homolog: EC 3.6.3.1 Phospholipid-translocating ATPase
LPRNLFEQFRRLSYVYFLAITVLNQLPQVAVFGRGASVLPLAFVLFVTAVKDAYEDFRRHRSDRQENNRLASVLAPGTAGDFEPKRWKHIRVGDVVRVASNETLPADMALLATSDPTGVAHVQTVNLDGETNLKTRYAKQETQVRFSQNGGVGGILHCERPNRNIYGFQANLDIDGKRVSLGPSNIVLRGCELKNTTWAIGVVVY

SEQ ID NO: 49477 - DNA, 593 bp, Panicum virgatum
  misc_feature: Ceres CLONE 2050150
  misc_feature: Encodes the peptide sequence at SEQ ID NO. 49478
aaccgaaaaaccaaggggggaaaatagtaaagaaacggaggcgagcgaggcgaggcttgcccccctcctcctcctcctccccgtttcttatctatcctgatccgaatccgcctcgcttcttatatcctcctccgaggaaaataattccatctcccctccccaccgcatctcgccctgctcgcctccgtcgccgccgccgccgtcgccatggccaccgaggaagccgccaagccgtccccgctcccgccctacccggagatgatcctggcggcgatcgaggggctggacgacaagaacgggtcgaacaagtcggccatctcgaggtacatcgagggcaagtacggcgagctgcccccggcgcacccgtcgctgctgacggcgcacctgtcgcgcatgaaggagtccggcgagctcatcttcttcaagaacaactacttccgcgccgacgcccccgacgcgccgccgaagcgcggccgcgggcgcccgcccaaggtgcgggaccccaacgcgccgccgccgccgcccaaagcgccgtcctccggctcgccgcgcccccgcgggcgcccgcccaagccaaagatccgctggacgcc

SEQ ID NO: 49478 - protein, 128 aa, Panicum virgatum
  misc_feature: Ceres CLONE 2050150
  misc_feature (11)..(80): Pfam Name: Linker_histone Pfam Description: linker histone H1 and H5 family
  misc_feature: The sequence is a functional homolog of SEQ ID NO 138 in the 11/375,241 US patent application
  misc_feature: The sequence is a functional homolog of SEQ ID NO 204 in the 10/412,699 US patent application
  misc_feature: The sequence is a functional homolog of SEQ ID NO 2286 in the 10/374,780 US patent application
  misc_feature: The sequence is a functional homolog of SEQ ID NO 56 in the 10/669,824 US patent application
  misc_feature: The sequence is a functional homolog of SEQ ID NO 56 in the 10/870,198 US patent application
  misc_feature: The sequence is a functional homolog of SEQ ID NO 706 in the 10/225,066 US patent application
  misc_feature: Functional homolog of the protein sequence given in SEQ ID NO 51584
  misc_feature: Useful for making plants with modulated nitrogen use efficiency
MATEEAAKPSPLPPYPEMILAAIEGLDDKNGSNKSAISRYIEGKYGELPPAHPSLLTAHLSRMKESGELIFFKNNYFRADAPDAPPKRGRGRPPKVRDPNAPPPPPKAPSSGSPRPRGRPPKPKIRWT

SEQ ID NO: 49479 - DNA, 650 bp, Panicum virgatum
  misc_feature: Ceres CLONE 2050168
  misc_feature: Encodes the peptide sequence at SEQ ID NO. 49480
atcttcgctgattaatgaagctaccttccctcaaaaaaaaaaaaaaatccggcgcctcctcttccgccactccgtcgagcaccccgcgcgcgctcccgctgctgcctgctatgctcctccgcccgcgcccctccctcctccgagccctcgctccgccgccgcttacccacgcctgcgtccctgcccggcgtacgctctcggcggccgcagaggccgcggggaccgcctccgctggcgatgcggcgccggcgccggctgcaccgcgcaagaataccaggaaggtcccgcagccgccaagggagattgtgaagacggcgctgttcctgccgcccggggtggagcgggacgcggcggtgaccgcggacatggtcataccggggtcgaacatcgtgttggggccctacgcgggggacgccagggtgaaggaagccgagttcgtcaagagcagcgcccgcgcccgggactgccccaaggacgaccgccccgagttcgccgtcctcggccggtccaacgtcggcaagtcctcgcttatcaatgccctcacccgtcgcaaggaagctgcgctgacctcgaagaagcccgggaagacccagacaattaatcactttttggttaacaagagttggtaccttgtcgatttgcctggttat

SEQ ID NO: 49480 - protein, 179 aa, Panicum virgatum
  misc_feature: Ceres CLONE 2050168
  misc_feature (125)..(179): Pfam Name: MMR_HSR1 Pfam Description: GTPase of unknown function
  misc_feature: Functional homolog of the protein sequence given in SEQ ID NO 51047
  misc_feature: Useful for making plants with modulated heat sensitivity
MLLRPRPSLLRALAPPPLTHACVPARRTLSAAAEAAGTASAGDAAPAPAAPRKNTRKVPQPPREIVKTALFLPPGVERDAAVTADMVIPGSNIVLGPYAGDARVKEAEFVKSSARARDCPKDDRPEFAVLGRSNVGKSSLINALTRRKEAALTSKKPGKTQTINHFLVNKSWYLVDLPG

SEQ ID NO: 49481 - DNA, 673 bp, Panicum virgatum
  misc_feature: Ceres CLONE 2050180
  misc_feature: Encodes the peptide sequence at SEQ ID NO. 49482
aggcccagtcccccacccgcccgccacccaacgcggcgggcgcgtcgccatggcgctcgcgctccgtctcctgctccccctgctcctcctagccgccgccgccgccgccgccgcgctcacgcccgacggccaggcgctgctggcgttcaaggcggccgtcgtccaggaccccacgggggcgctcgccaactgggacgccaccgccgcggacccctgcgcctggaacggcgtcgcctgctcctcctcctcctcccccgccgccggcgccacccagccccgccgcgtcgtcgcgctctcgctccccaagaagcgcctcgtcgcggcgctcccggcggcgccgctcccttcgtcgctgcgccacctcaacctccgcagcaaccgcctcttcggccccgtcccgcccgcgctcgtctccggcgcgcccgcgctccagagcctcgtcctctacgggaacgcgctcgacggcccgctccccgacgagctcggggccctgcccttcctccagatcctcgacctctcctccaatgccctcaacggctccctcccaccctcgatcctcaaatgccgccgcctccgcgcgctcgcgctcgcgcggaacaacctcacgggcccgctccccgcaggcttcggcgcccagctctccgctctggagcgcctcgacctctccttcaac

SEQ ID NO: 49482 - protein, 207 aa, Panicum virgatum
  misc_feature: Ceres CLONE 2050180
  misc_feature (23)..(64): Pfam Name: LRRNT_2 Pfam Description: Leucine rich repeat N-terminal domain
  misc_feature: SWISSPROT Homolog: EC 2.7.11.1 Non-specific serine/threonine protein kinase
MALALRLLLPLLLLAAAAAAAALTPDGQALLAFKAAVVQDPTGALANWDATAADPCAWNGVACSSSSSPAAGATQPRRVVALSLPKKRLVAALPAAPLPSSLRHLNLRSNRLFGPVPPALVSGAPALQSLVLYGNALDGPLPDELGALPFLQILDLSSNALNGSLPPSILKCRRLRALALARNNLTGPLPAGFGAQLSALERLDLSF

SEQ ID NO: 49483 - DNA, 693 bp, Panicum virgatum
  misc_feature: Ceres CLONE 2050195
  misc_feature: Encodes the peptide sequence at SEQ ID NO. 49484
aacccttcacttcgcgtcttgaccacgtccccctttctctccccccagacggccagtcctctcctcaagtgttccagacttccagtcctcggctccgcccctcgcctgacacaggccacgcgccgcggcggccgtaaccgtacgggcgcgctagggtttccctcctctgctgcagcgggcggccgccatggcgcggcgccacgggtggctataactgtgtacttcttgctttgtatagctttctatgctttcttctctccatttcttgggaaggacgtgtatcagtatgtcgctgtgggtgtttatagttttctggccttagctgtgctgatcctatatgttagatgtactgcgattgatcctgctgaccctggcatcctgatttctatggacggtgctctaatttataaatcagaagcacatacagacactcaagatgaagctggcaagtcaggattgagaaacagtgaggatatccctaagcataattcgtgcttaggtaggatttgtttttgttgtgctgtttttactatagaggattgttgcaaagaggatgaaattaaccaacaagaggattatggtgaagaggcactattttgcaccctttgcaacgcggaggtgcgaaaacatagtaagcactgtcgaagttgtgataagtgtgttgatggctttgatcatcactgccggtggctg

SEQ ID NO: 49484 - protein, 230 aa, Panicum virgatum
  misc_feature: Ceres CLONE 2050195
  misc_feature (191)..(230): Pfam Name: zf-DHHC Pfam Description: DHHC zinc finger domain
NPSLRVLTTSPFLSPQTASPLLKCSRLPVLGSAPRLTQATRRGGRNRTGALGFPSSAAAGGRHGAAPRVAITVYFLLCIAFYAFFSPFLGKDVYQYVAVGVYSFLALAVLILYVRCTAIDPADPGILISMDGALIYKSEAHTDTQDEAGKSGLRNSEDIPKHNSCLGRICFCCAVFTIEDCCKEDEINQQEDYGEEALFCTLCNAEVRKHSKHCRSCDKCVDGFDHHCRW

SEQ ID NO: 49485 - DNA, 636 bp, Panicum virgatum
  misc_feature: Ceres CLONE 2050205
  misc_feature: Encodes the peptide sequence at SEQ ID NO. 49486
acccgaggtaacctccgtcggttcgggctctcgtcgcctaccctacccaagcgtcacacgcagacgccttcgaaccctagtcacccgcgccgcccctgcgctccccggccgcctcctgcccccggcggcggctgcggcctcggcgtcagcgaagatgtagggcggcttcttccgggggacgtccgctgaccaggacacgcgcttctccaacaagcaggcgaagctgctcaagacacagaatttcgcgcctgagcttgaccacttggtggacatgtctaaggtcaagatggatgtgatgaagccctggatcgccaagcgggtcactgagctcctcgggttcgaggatgaagtgctcatcaacttcatctatggcctcctcgaagagaaggcggcagatgggaagaagattcagatccagctaacaggattcatggagaagaacacagtaaagttcatgaaggagctctggagcctcctcctaagtgcgcaacagaatgccagtggggtacctcaacagtttctagatgcaaaggaggctgaaatacagcagagaaaggcagaggatgatagaattgcacaggagatccaaaaaaagcgggagaaagagggaagagacttagaactggagaagcagaa

SEQ ID NO: 49486 - protein, 121 aa, Panicum virgatum
  misc_feature: Ceres CLONE 2050205
  misc_feature (6)..(78): Pfam Name: PWI Pfam Description: PWI domain
MSKVKMDVMKPWIAKRVTELLGFEDEVLINFIYGLLEEKAADGKKIQIQLTGFMEKNTVKFMKELWSLLLSAQQNASGVPQQFLDAKEAEIQQRKAEDDRIAQEIQKKREKEGRDLELEKQ

SEQ ID NO: 49487 - DNA, 708 bp, Panicum virgatum
  misc_feature: Ceres CLONE 2050211
  misc_feature: Encodes the peptide sequence at SEQ ID NO. 49488
ggctcatcatcaccacccacctctcctcccctccgccgcgacctcctcctcgtcccccggcgctactcccccgctccacggtccaagggtaagcgcgcctccccaccgctccctacctctatatagccccccttcctctctccctcgcccgctcccccattccctcgccttcgccacctcccgcgcctctcggatcgcctcggtgcgcgaaagatggcatcccatattgttggttaccctcgcatgggccccaagagggagctcaagtttgccttggagtctttctgggatgggaagagcagcgctgaggatttggagaaagttgccactgacctcaagtctagcatctggaagcaaatgtcagaagctgggatcaagtacattcccagcaacaccttctcatactatgaccaggtccttgatacgacggccatgcttggcgctgtcccagaacggtactcttggaccggaggtgagattggcctgagcacctacttctcaatggccaggggaaatgccactgttcctgctatggagatgacaaagtggtttgacacaaactaccacttcattgtccctgaacttggcccgagcaccaagttctcatatgcttctcacaaggctgtctccgaatacaaggaggcaaaggcgcttggcattgatactgtcccagtgcttattggaccagtctcctacttgttgctctct

SEQ ID NO: 49488 - protein, 164 aa, Panicum virgatum
  misc_feature: Ceres CLONE 2050211
  misc_feature (2)..(164): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
MASHIVGYPRMGPKRELKFALESFWDGKSSAEDLEKVATDLKSSIWKQMSEAGIKYIPSNTFSYYDQVLDTTAMLGAVPERYSWTGGEIGLSTYFSMARGNATVPAMEMTKWFDTNYHFIVPELGPSTKFSYASHKAVSEYKEAKALGIDTVPVLIGPVSYLLL

SEQ ID NO: 49489 - DNA, 696 bp, Panicum virgatum
  misc_feature: Ceres CLONE 2050228
  misc_feature: Encodes the peptide sequence at SEQ ID NO. 49490
tatggctgaggaataatcaaatagctgggcagattactacagacttgcctcatggcctgcaatcgctacgacttacctccaataatcttacaggaaccatccctacttgccttgccaatatcacaacattagaggtacttgattttgtgtacaataatatttggggcaacatcccaaatgagtttgcaacgttgtcagagctacaatacttgttggtgggttccaataatttgtccggtaactttccactgtctgtcctgaatctttctaacctagttggatttaacattgccttgaatgatctaagtggagatgtaccatcctatgtcggcaactctctacccaatcttgagatactcgatttgggcaataacttgtttcacgggaatatcccatctggattaacaaatgcttccaacctgagagatattgacatttcaaacaataagttcaccggggtggtacctagttccatcggcaaactttctaggctatatttcttacatcttggggcaaataaactgtacgcgaaaagcgaacaagactgggagtttatgaatagcttagccaattgcactgagctgcatgagttctctatttatcagaatcgtttggaaggcaatgtgccaaattcattcggtaacctttccgctaatctccaaattctgaccttttctgaaaatcaactgtctgggg

SEQ ID NO: 49490 - protein, 231 aa, Panicum virgatum
  misc_feature: Ceres CLONE 2050228
  misc_feature: SWISSPROT Homolog: EC 2.7.11.1 Non-specific serine/threonine protein kinase
WLRNNQIAGQITTDLPHGLQSLRLTSNNLTGTIPTCLANITTLEVLDFVYNNIWGNIPNEFATLSELQYLLVGSNNLSGNFPLSVLNLSNLVGFNIALNDLSGDVPSYVGNSLPNLEILDLGNNLFHGNIPSGLTNASNLRDIDISNNKFTGVVPSSIGKLSRLYFLHLGANKLYAKSEQDWEFMNSLANCTELHEFSIYQNRLEGNVPNSFGNLSANLQILTFSENQLSG

SEQ ID NO: 49491 - DNA, 675 bp, Panicum virgatum
  misc_feature: Ceres CLONE 2050231
  misc_feature: Encodes the peptide sequence at SEQ ID NO. 49492
  misc_feature (578)..(578): n is a, c, t, g, unknown, or other
atttgaggcagagggtaggactctagcccagaaagagaagtcggaggcaattgactcgaacgtcattactcccgggacacagttcatgtttgtactatctacggcgcttcagtactacatacaattgagattaaatcatacccttggatggcagtctgtcaaggtaatattgtctgattccaatgtccctggagagggagagcacaaaattatgtcatacatccgcctgcagcgcaatcttcctggatttgatcccaatacacgccattgcttatacggcctcgatgctgatttgattatgcttgcactggcaactcatgagatccacttctcaattttaagagaggtgatctccatgccagggcaacaagaaaaatgttttctgtgcggtcaagttgggcatttggctgctgaatgcagaggccctagccaggctgataattctgtggagctacctcctattcataaaaagaagtaccagtttcttaacatatgggtgctgcgtgaatacctggcaaaggatttggaaattgtagatgctcccttcaagataaactttgaacgccttatcgatgatnttgtgtttatgtgtttctttgttggcaatgactttctgcctcacatgccaactttagaaattcgtgagggtgctattacccttctcatgagtatcta

SEQ ID NO: 49492 - protein, 224 aa, Panicum virgatum
  misc_feature: Ceres CLONE 2050231
  misc_feature (1)..(117): Pfam Name: XRN_N Pfam Description: XRN 5'-3' exonuclease N-terminus
  misc_feature (124)..(141): Pfam Name: zf-CCHC Pfam Description: Zinc knuckle
  misc_feature (193)..(193): Xaa is any aa, unknown, or other
FEAEGRTLAQKEKSEAIDSNVITPGTQFMFVLSTALQYYIQLRLNHTLGWQSVKVILSDSNVPGEGEHKIMSYIRLQRNLPGFDPNTRHCLYGLDADLIMLALATHEIHFSILREVISMPGQQEKCFLCGQVGHLAAECRGPSQADNSVELPPIHKKKYQFLNIWVLREYLAKDLEIVDAPFKINFERLIDDXVFMCFFVGNDFLPHMPTLEIREGAITLLMSI

SEQ ID NO: 49493 - DNA, 700 bp, Panicum virgatum
  misc_feature: Ceres CLONE 2050239
  misc_feature: Encodes the peptide sequence at SEQ ID NO. 49494
caagcagaggggaacaggggaggaaaaaaaaaaaatagagaggagagacctcgcagctcacgcgcacacgccaaaccccaatcggagccgctgccgccgacgccgatccggagcaaggtatcaaatccatggcgagcggaggcgatggcgcagggagcggcgagtccccccctgctgccgcggcgggggcgacgctgcacatccggtgcgcgaacggctccaagttcacggtgcaggccgacctggccgccacggtgggcacgttcaaggaggtcgtggccgggagctgtgacgtgccggcgccgcagcagcgcctgatctacaagggccgtatcatcaaggacgagcaaaccctagaaagctacggcgttgagacagatcacacaattcacttggtgcgtggtgttgccgcaccggctgcatcaggtgcacctgctgctgccagtccccttgcttcatctactcctagcagtggcccagcaggtggcctgggaggcctatttccaggtgttggtgctccaagaagtggcaggccatcaggtttatttggagcaggatttccagaattagagcaagttgagcagcatttaagccagaatcccaacttgatgagggagatgatgaatatgccagcaatgcaaaatctcatgaacaacccagatttaatacgcaatatgatcatgagcaacccacagttgcg

SEQ ID NO: 49494 - protein, 190 aa, Panicum virgatum
  misc_feature: Ceres CLONE 2050239
  misc_feature (26)..(94): Pfam Name: ubiquitin Pfam Description: Ubiquitin family
MASGGDGAGSGESPPAAAAGATLHIRCANGSKFTVQADLAATVGTFKEVVAGSCDVPAPQQRLIYKGRIIKDEQTLESYGVETDHTIHLVRGVAAPAASGAPAAASPLASSTPSSGPAGGLGGLFPGVGAPRSGRPSGLFGAGFPELEQVEQHLSQNPNLMREMMNMPAMQNLMNNPDLIRNMIMSNPQL

SEQ ID NO: 49495 - DNA, 597 bp, Panicum virgatum
  misc_feature: Ceres CLONE 2050249
  misc_feature: Encodes the peptide sequence at SEQ ID NO. 49496
atcctcgaactcgcgtcgaagtcgtcgactcgccggccgccatgagcagcatcgcgtaccattacctcttcaagctgctcctcatcggcgactcatccgccggccagtcctgcctcctcctccggttcgctgaccattcatatgttgatacttacctcaacaccctcggggttgatttcaacattcggacggtccagctcgatggaaagacggtcaagctgcagatttgggacacagctggccaggaaaggttcaggacaattacaagcagttactaccgaggagctcatggaatcattattgtatatgacgtgacggacatggagagcttcaataacatcaagcagtggctgagtgagattgataggtatgctagtgacagtgtatgcaagctgctagttgggaacaagtgtgatttggttgataataaggttgttgataccgaaaaggcaaaggcttttgcggattcactaggaattccctttattgagacaagtgcaaaggaatccatcaatgttgaggaagctttcctaaccatgtcatcaaaaataaagaaaaggatggcagcccaacccagcgtggagagaagacccaccg

SEQ ID NO: 49496 - protein, 185 aa, Panicum virgatum
  misc_feature: Ceres CLONE 2050249
  misc_feature (11)..(172): Pfam Name: Ras Pfam Description: Ras family
  misc_feature (11)..(125): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50630
  misc_feature: Useful for making plants with altered lignin content
  misc_feature: Functional homolog of the protein sequence given in SEQ ID NO 50522
  misc_feature: Useful for making plants with modulated oxidative stress sensitivity
MSSIAYHYLFKLLLIGDSSAGQSCLLLRFADHSYVDTYLNTLGVDFNIRTVQLDGKTVKLQIWDTAGQERFRTITSSYYRGAHGIIIVYDVTDMESFNNIKQWLSEIDRYASDSVCKLLVGNKCDLVDNKVVDTEKAKAFADSLGIPFIETSAKESINVEEAFLTMSSKIKKRMAAQPSVERRPT

SEQ ID NO: 49497 - DNA, 547 bp, Panicum virgatum
  misc_feature: Ceres CLONE 2050251
  misc_feature: Encodes the peptide sequence at SEQ ID NO. 49498
gaaccagcagtacaagaagcacaagaaaaaacacttgtagccatcaacttcttcttcttcttcttcaccgtcatcaactcatcatcagctcagaccgtgagtggaatcccgtgagtgcaaataaagcatcgatcgatccgcagctagctagcgaccgaagaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctttgtatgtatggatgtgtgttgttaccctatggatccaataaataagggatgtaaaaggtgaataaagcatcgattgtgtgtagccttac

SEQ ID NO: 49498 - protein, 74 aa, Panicum virgatum; identical to SEQ ID NO: 18697
  misc_feature: Ceres CLONE 2050251
  misc_feature (15)..(74): Pfam Name: potato_inhibit Pfam Description: Potato inhibitor I family

SEQ ID NO: 49499 - DNA, 695 bp, Panicum virgatum
  misc_feature: Ceres CLONE 2050263
  misc_feature: Encodes the peptide sequence at SEQ ID NO. 49500
acacatttaaagactcacagggagcagacactgctgttcttctctcgggggcaacaattgttgatcgtgctgtcatcataaatccagctgagaactatcaactgcctcctgaagcacacaaacaattatcgggagcaagccccactgctgaatctgcagtcaggaaggcagaagatgttgtcagcagcatgttggccaagggcttcgtcctcagcaaggatgctctcaatttagcaagatcctttgatgagcgtcacaacatcctgtccaatgctacagccactgtcgcatccataggccgccagtatggcctgagtgaaaagatcaatctgggccgaacaattgtcggcagcaaggtcaaggaggtagatgaacgttaccaggtctcagaactcactaagtctgctttggccgctgctgagcagaaagccagtattgcaggctctgctatcttgagtaaccaatatgtctcagctggtgcttcctggttaaccagtgcattcggtatggtaactaaggcggcaggtgacatgacctcgatggcgaaagacaaggtagagagggctgaggaggagagaaaagccatcatgtgggaggagaggaacgggctggtgagcgactatgcaaagatccacctcgacgagccctcttcatgggaacctgcagttcttcctttggaatcagtggatgagcag

SEQ ID NO: 49500 - protein, 230 aa, Panicum virgatum
  misc_feature: Ceres CLONE 2050263
  misc_feature: Functional homolog of the protein sequence given in SEQ ID NO 51548
  misc_feature: Useful for making plants with altered alkaloid content
  misc_feature: Functional homolog of the protein sequence given in SEQ ID NO 50683
  misc_feature: Useful for making plants with altered lignin content
TFKDSQGADTAVLLSGATIVDRAVIINPAENYQLPPEAHKQLSGASPTAESAVRKAEDVVSSMLAKGFVLSKDALNLARSFDERHNILSNATATVASIGRQYGLSEKINLGRTIVGSKVKEVDERYQVSELTKSALAAAEQKASIAGSAILSNQYVSAGASWLTSAFGMVTKAAGDMTSMAKDKVERAEEERKAIMWEERNGLVSDYAKIHLDEPSSWEPAVLPLESVDE

SEQ ID NO: 49501 - DNA, 545 bp, Panicum virgatum
  misc_feature: Ceres CLONE 2050273
  misc_feature: Encodes the peptide sequence at SEQ ID NO. 49502
accacgtctccccctctcctcccctgccacctcacgcggtaagctgctgcagctgctgcttgccttggccgagcgactgagctagtacaactgacacgcaagagcacaggcggctctcgcttctctcctccgtggtgctgctgatggggtgggggtgggcggcggcggtgctagccgcggcgtacgtggcggcgaagctgatggaggtgctgtggtggcggccgcggcgggtggaggagcacttcgcgcggcaggggatcaggggcccgcgctaccgcttcttcgtgggctgcgtccgcgagatggtggcgctcatggtggccgcctccgccgccccaatgccgcgcccctaccgctcccacaacgtgctcccgcgggtcctcgccttctaccaccactggaggaaaatctacggttccacgttcctgatatggttcggcccgacaccgaggctcgccgtcgccgaccccgacctcatccgtgagatcctcgtgtcccgcgccgagcacttcgaccgctacgagtcgcaccccatggtgcgccag

SEQ ID NO: 49502 - protein, 133 aa, Panicum virgatum
  misc_feature: Ceres CLONE 2050273
  misc_feature: SWISSPROT Homolog: EC 1.3.3.9 Secologanin synthase
  misc_feature: The sequence is a functional homolog of SEQ ID NO 2 in US patent 7034205
MGWGWAAAVLAAAYVAAKLMEVLWWRPRRVEEHFARQGIRGPRYRFFVGCVREMVALMVAASAAPMPRPYRSHNVLPRVLAFYHHWRKIYGSTFLIWFGPTPRLAVADPDLIREILVSRAEHFDRYESHPMVR

SEQ ID NO: 49503 - DNA, 701 bp, Panicum virgatum
  misc_feature: Ceres CLONE 2050275
  misc_feature: Encodes the peptide sequence at SEQ ID NO. 49504
aagcaaggccatgttctgacagtagctggaggatcgcgatcaccgcccgagcatgagggcgggcgcgctctgcctcgtcctcctcgccgcgttcctccccctttccgcgtccaccgactctatcggcctggccgcgtccatcgccggcaaccagacgctcgtctcgcccgggggagtcttccagctcggcttcttcagccccccggacggcggcgccggcaggaggtacctcggcatttggtactacagcatccgggagccgaggccgaccgtcgtgtgggtcgccaaccgccagaccccgctcgtgggctccccgggcgtattccgcctctccgccgacggccgcctcgtcgtcctcgacgcccagaacggcaccgtcgtctggtcctccgcggcgcccaccaggaacgtgaccgccggcgccaccgcgcggctccgggacgacggtaacttcatcctcagctcggacggcagcggctccgaccagagcgtggcgtggcagagctacgactacccgactgacactctgctcccgggcatgaagctcggggtggacctgagggccggcatcacccggaacatcacgtcgtggagcagccccgccgacccttcccccggcgcctacacgttccggctggtcctcagaggcctgccgcagctcttcctcctccggggcgccgccaagatctacacgagcgggc

SEQ ID NO: 49504 - protein, 216 aa, Panicum virgatum
  misc_feature: Ceres CLONE 2050275
  misc_feature (71)..(187): Pfam Name: B_lectin Pfam Description: D-mannose binding lectin
MRAGALCLVLLAAFLPLSASTDSIGLAASIAGNQTLVSPGGVFQLGFFSPPDGGAGRRYLGIWYYSIREPRPTVVWVANRQTPLVGSPGVFRLSADGRLVVLDAQNGTVVWSSAAPTRNVTAGATARLRDDGNFILSSDGSGSDQSVAWQSYDYPTDTLLPGMKLGVDLRAGITRNITSWSSPADPSPGAYTFRLVLRGLPQLFLLRGAAKIYTSG

SEQ ID NO: 49505 - DNA, 665 bp, Panicum virgatum
  misc_feature: Ceres CLONE 2050279
  misc_feature: Encodes the peptide sequence at SEQ ID NO. 49506
acatctcgagcagtcggagttcatccccgagcagacctcgcaagccgcgcatcttcttctcctcctgctccagatctcaggcgaaagcttgtccaccatccaccgccacagcatcccaatggctcgcttcgccgtcgtcgccgccatcgtcgcgctcctcgccgtcaccgcggccgcgcaggccccggccgcgacgcccaccccggcgcccaggatggccccgctgccgccgcctccggcgcggtccccggccaccaccccggccccggccgcgaagccgcccaccgcctcggcgccgtccccgctgtcctctcccccggccccgcccgccgagggcccctccgcgatgaccccgaccacctccgtctccgccgccctcgccggcgcccccaccgccacgcccaccgggaatggcgccgcctcctccgccgtcagcttcgtcgccgtcgccgccgcggtcgccgccgccgtcgtgttctagatggggacgcgttgcgactatgggatctcgagctgtttatactgccatattctttttttgcgattcttttttactgtattagatactgatgatgagagagcagaggagaggacatttgaggggggattcacccagtgctgctagttacacatcatgcatgattcatgatgatatgattattaat

SEQ ID NO: 49506 - protein, 120 aa, Panicum virgatum
  misc_feature: Ceres CLONE 2050279
  misc_feature: Functional homolog of the protein sequence given in SEQ ID NO 50188
  misc_feature: Useful for making plants with altered carbohydrate content
MARFAVVAAIVALLAVTAAAQAPAATPTPAPRMAPLPPPPARSPATTPAPAAKPPTASAPSPLSSPPAPPAEGPSAMTPTTSVSAALAGAPTATPTGNGAASSAVSFVAVAAAVAAAVVF

SEQ ID NO: 49507 - DNA, 643 bp, Panicum virgatum
  misc_feature: Ceres CLONE 2050281
  misc_feature: Encodes the peptide sequence at SEQ ID NO. 49508
ccgccgcttcttccacgcctcagggggacccacctatctccggccaccgccgcccatcccgagattctcccaacgcccgcgccccagatctcgcgacgcaaccgtccgcatcgatggggagctcaccggcggcggcgggcacggcgctggaggacctgccggaggacgcgctgctgtgcatcctcgcgctgctcgcgccgcccgacgccgccgccgccgcctgcgcctgccgccgcctcgccgccgccgcgtcctccccggcgctcccgcccgccctcgcgctccgcctcggcctcctgccgccctccccggcgcgcccgctcctcccggccccgccctcccccgccgccgcgcgcaggctcctccgctcgctccaccgcctccgccgcctcctcggcctctggcgccgcctcccgccctcctccggctccccgcagccccgcccgcccgctccgtccctcgccgcgttcgagtgggcccccgcgcgcgccgcgctcgcgggctccctcctcgccccctccgccgcgcgcggcggcggcggcggggtcgccaggtgccccttcgtcacgctctgcatcgccgactccggggacaccgtggcagcgctcgggggcgcccccgtctgcgtcaacttcgtcggcag

SEQ ID NO: 49508 - protein, 176 aa, Panicum virgatum
  misc_feature: Ceres CLONE 2050281
  misc_feature (10)..(57): Pfam Name: F-box Pfam Description: F-box domain
MGSSPAAAGTALEDLPEDALLCILALLAPPDAAAAACACRRLAAAASSPALPPALALRLGLLPPSPARPLLPAPPSPAAARRLLRSLHRLRRLLGLWRRLPPSSGSPQPRPPAPSLAAFEWAPARAALAGSLLAPSAARGGGGGVARCPFVTLCIADSGDTVAALGGAPVCVNFVG

SEQ ID NO: 49509 - DNA, 702 bp, Panicum virgatum
  misc_feature: Ceres CLONE 2050294
  misc_feature: Encodes the peptide sequence at SEQ ID NO. 49510
gcgctgccgctgccgctgacgccgccgcgctgcccctcccatggctctcctcgcgctccgtattgggccgcttctcccagccccgccacaacgccgccggatcctccgcaaccggtgccgggtccggatcgtcgcctccaatgccaccacacccgtgagggacgggggcgcggccgcggtggtgtggttcaagcatgacctccgcatcgacgaccacccgggcctcgccgccgccgtcgcggagccgcggcgccctgtcgtgccgctctacgtcttcgaccggcgcatcctcgcaggttattcagataaaatgctggaactgctgctatttgctctgaaagatcttaagatggcgttgaagtctcaagagtctgatctgcttataggcttgggaaatgctgaagatgttgtgctgaagcttgtgaatgaggtgcaagcaggtcttatttttacagaagaggaagttgaatatagagtgcgcaatgttctggccaatgttgaatcatctttatctaatgggtcattctcatggggaagccctcccaagatagtggcttggagtgccccgttgtatgactataagaatttggaagaagtatcgacgccatacgaccaatttttaaagaaaaaactaccaatggccacacctcttgctgctacagctttgcctgctctaaatttggagttagacacaggttttct

SEQ ID NO: 49510 - protein, 220 aa, Panicum virgatum
  misc_feature: Ceres CLONE 2050294
  misc_feature (44)..(214): Pfam Name: DNA_photolyase Pfam Description: DNA photolyase
MALLALRIGPLLPAPPQRRRILRNRCRVRIVASNATTPVRDGGAAAVVWFKHDLRIDDHPGLAAAVAEPRRPVVPLYVFDRRILAGYSDKMLELLLFALKDLKMALKSQESDLLIGLGNAEDVVLKLVNEVQAGLIFTEEEVEYRVRNVLANVESSLSNGSFSWGSPPKIVAWSAPLYDYKNLEEVSTPYDQFLKKKLPMATPLAATALPALNLELDTGF

SEQ ID NO: 49511 - DNA, 414 bp, Panicum virgatum
  misc_feature: Ceres CLONE 2050307
  misc_feature: Encodes the peptide sequence at SEQ ID NO. 49512
aaaataacctgacagacctcccagaggagcttggtcacctgacaaacctagagaagattgacatgcgggaatgctcacggctaaggagcctcccgaggtcgtcgtcctccctcaagtccctcggtcacgtcgtctgcgacgaggagacggcgttgctgtggagagaggccgagcaggtaatccctgacctccgggtgcaggtggcagaggagtgttataacctggactggcttgtagactgatgtcacgttctggatgctttgggcttccaaactgaccatgtacatatgatgtttatatgttgccctgtctagtgcaggaagagtaacaatccaaaatggcaaattttgacatactcagtcagtgttcatgcaccgactcagttttgagaatggcaaaattgtaaatttctct

SEQ ID NO: 49512 - protein, 79 aa, Panicum virgatum
  misc_feature: Ceres CLONE 2050307
  misc_feature: Functional homolog of the protein sequence given in SEQ ID NO 51772
  misc_feature: Useful for making plants with modulated water use efficiency
  misc_feature: Functional homolog of the protein sequence given in SEQ ID NO 51773
  misc_feature: Useful for making plants with modulated drought sensitivity
NNLTDLPEELGHLTNLEKIDMRECSRLRSLPRSSSSLKSLGHVVCDEETALLWREAEQVIPDLRVQVAEECYNLDWLVD

SEQ ID NO: 49513 - DNA, 637 bp, Panicum virgatum
  misc_feature: Ceres CLONE 2050327
  misc_feature: Encodes the peptide sequence at SEQ ID NO. 49514
tcccgccgtcctcgccttccccgcccaccgccgccatgggccgcaagcttcccgccgagcaagcggaacccaggagcagcaaaaaggagaagaagagcaagaaggacaagaagcggaagctcgcggccgaggccgaggccgaggcggcggcgacggaggaggcggtcgcgaagagcagcaagaagaagcgggcggaggatgggcccggcggcggcggagcaggggaggcggagaacggagccgagaaggccgtggcggtgaccgggaagggctccgaggaccccaagtacgcggccctgcgttcgttctccgccgccgagctgccgtcccaggtgctcgactgctgcaaagagttcgcgcggccgtcgcccatccaggcgcactcctggccgttccttctcgacggccgcgacctcatcggcatcgccgccaccggatccgggaagacaattgccttcggtgtgccggcgctgatgcacatcaggaagaaggtaggagggaaaacggggaagaaggccgtgccgcggtgcctcgtgctgtcgccgacgagggagctcgctcagcagattgcagatgtacttagtgaggctggtacaccttgtgggataaattcagtttgcctttatggtggaacttc

SEQ ID NO: 49514 - protein, 200 aa, Panicum virgatum
  misc_feature: Ceres CLONE 2050327
  misc_feature (111)..(200): Pfam Name: DEAD Pfam Description: DEAD/DEAH box helicase
MGRKLPAEQAEPRSSKKEKKSKKDKKRKLAAEAEAEAAATEEAVAKSSKKKRAEDGPGGGGAGEAENGAEKAVAVTGKGSEDPKYAALRSFSAAELPSQVLDCCKEFARPSPIQAHSWPFLLDGRDLIGIAATGSGKTIAFGVPALMHIRKKVGGKTGKKAVPRCLVLSPTRELAQQIADVLSEAGTPCGINSVCLYGGT

SEQ ID NO: 49515 - DNA, 707 bp, Panicum virgatum
  misc_feature: Ceres CLONE 2050338
  misc_feature: Encodes the peptide sequence at SEQ ID NO. 49516
cgtgctctgctcatcatctcctcctcttcctcctccacctccgcgccgctcccgtcttcctcggaaagatggcgtcccacattgttggatacccccgcatgggccccaagagggagctcaagtttgccctcgagtctttctgggatgggaagagcagcgctgaggatttggagaaggtcgctaccgacctcagggccaacatctggaagcagatgtccgaggctgggatcaagtacattcccagcaacactttctcctactatgaccaggttcttgacaccaccgccatgctcggtgctgtcccggagcgctactcatggaccggaggagagatcgggttcgacacctacttctcaatggctaggggtaacgccactgtccctgctatggagatgaccaagtggtttgacaccaactaccactttattgtccctgagctgggccccaacaccaagttttcctactcttctcataaggctgttaacgaatacaaggaggccaaggcgcttggagttgataccgtgccagtgcttgttggaccagtctcgtacctgttgctctcgaagcctgccaagggtgtggagaagggtttccctcttctttccctttttagcagcatcctccctgtctacaaggaggtcattgctgaactgaaggcagctggcgcttcatggattcagtttgatgaacccacccttgtcctcgac

SEQ ID NO: 49516 - protein, 212 aa, Panicum virgatum
  misc_feature: Ceres CLONE 2050338
  misc_feature (2)..(212): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
MASHIVGYPRMGPKRELKFALESFWDGKSSAEDLEKVATDLRANIWKQMSEAGIKYIPSNTFSYYDQVLDTTAMLGAVPERYSWTGGEIGFDTYFSMARGNATVPAMEMTKWFDTNYHFIVPELGPNTKFSYSSHKAVNEYKEAKALGVDTVPVLVGPVSYLLLSKPAKGVEKGFPLLSLFSSILPVYKEVIAELKAAGASWIQFDEPTLVL

SEQ ID NO: 49517 - DNA, 634 bp, Panicum virgatum
  misc_feature: Ceres CLONE 2050369
  misc_feature: Encodes the peptide sequence at SEQ ID NO. 49518
aaaaaaaagacccgaagctgacgcgcccaacccacagcgcacagccaccacatccccacatggccgcgctcgccggcggcggctccccgcccctcccgccgccggcgccgtcgtcgaagggcaaggccaagatggacggcgaggcggaggcggagggcgcggggaagatgtgcggcatctgctacgtcgacggcgcgcgggccatccgcggcgagctcgactgctgcgcccactacttctgcttcgtctgcatcatggcctggggccgcgtcgagtcccgatgccccttctgcaaggcccgcttccgcaccatccgccgcccgcccgtcccggggcggttccccgacgagcgcatcgtctccgtccccgagcgcaaccaggcataccgtccccagggcaacgggagcgccacggcgggccgggatccgtacgcggacaccatctgcaccgtgtgcaacggctccagggacgacgagctgctgctgctctgcgagctctgcgactcggccgcgcacacctactgcgccgggctggggaccgtcgtgccggagggggactggttctgcaaggattgcgccacggtcagggaggagcagttgaggtggctggctgagaatgagggccgggacagcca

SEQ ID NO: 49518 - protein, 191 aa, Panicum virgatum
  misc_feature: Ceres CLONE 2050369
  misc_feature (128)..(175): Pfam Name: PHD Pfam Description: PHD-finger
MAALAGGGSPPLPPPAPSSKGKAKMDGEAEAEGAGKMCGICYVDGARAIRGELDCCAHYFCFVCIMAWGRVESRCPFCKARFRTIRRPPVPGRFPDERIVSVPERNQAYRPQGNGSATAGRDPYADTICTVCNGSRDDELLLLCELCDSAAHTYCAGLGTVVPEGDWFCKDCATVREEQLRWLAENEGRDS

SEQ ID NO: 49519 - DNA, 680 bp, Panicum virgatum
  misc_feature: Ceres CLONE 2050400
  misc_feature: Encodes the peptide sequence at SEQ ID NO. 49520
atttttttcctcctcctcccccacctgctctcccccgtccaccctccacgcccgcgagcccgccgcccccgtcgcatgccgccatggaccgcgccgacgctggcggcagcagtagcattagcgaccccgacgcgccctactccgcggcggccgcgctgctgctggagcccaagctcgaggacgaggagctgccgctgcggcagctggcgtcgccgggccccttcgtgcccctggaccagctgatgccgccggcggccgagccgccgcgcccgctcgaggcgctgctgcagggcccgcagctgccgccgttcctctccaagacctacgacctggtgagcgagccggcgctggacggggtcatctcctggggcgccgcggggaacagcttcgtcgtgtgggacccctccaccttcgcgcgcgacgtgctgccgcacaacttcaagcacaacaacttctccagcttcgtcaggcagctcaacacctatattgccgatgatgaagaccctgctgccgacttgttcttttttttcctgtgcgattctcttggttattggtgttgtatcgtgtggacctttgtaaaatctggcctgtaaatggagtgtgtatactttactacctttcttttctgagcggaatcgcaagatatatgtaatacaaacctgcccgagtgataatataac

SEQ ID NO: 49520 - protein, 169 aa, Panicum virgatum
  misc_feature: Ceres CLONE 2050400
  misc_feature (74)..(169): Pfam Name: HSF_DNA-bind Pfam Description: HSF-type DNA-binding
MDRADAGGSSSISDPDAPYSAAAALLLEPKLEDEELPLRQLASPGPFVPLDQLMPPAAEPPRPLEALLQGPQLPPFLSKTYDLVSEPALDGVISWGAAGNSFVVWDPSTFARDVLPHNFKHNNFSSFVRQLNTYIADDEDPAADLFFFFLCDSLGYWCCIVWTFVKSGL

SEQ ID NO: 49521 - DNA, 703 bp, Panicum virgatum
  misc_feature: Ceres CLONE 2050406
  misc_feature: Encodes the peptide sequence at SEQ ID NO. 49522
tgaacagatattaaatgttgttgccttttgccatcttcagggtgttgttcaccgtgatttgaagccagagaatttcctattcagcactaaggatgagcattctcctatgaagattattgattttggcctctcagattttataagaccagatgaaaggcttaatgacattgttggcagtgcatactatgttgctccagaagtcttgcatagatcatatagtacagaagcagacatgtggagtattggtgttatcacttatatattactttgtggtagcagaccattctgggcacgaactgaatcagggattttccgctcagtgctgagagctgatcctaattttgatgatacaccatggcaatcagtatctcctgaagctaaagattttgtcaaaagacttcttaacaaggactacaggaaaagaatgactgctgcccaggcactctctcacccctggttgcgagatgagcgccgacaaatacctcttgatatgctagtattcaagttggtcaaggcatatcttcgttcgacacctcttaaacgggcggcattgaaggctttgtcaagagcagtaacagaagatgagcttatctacatcagagcacaatacaacttgttagaaccaaacagcagagatggtcgaatatgtatcgacaacttcaagatggtaagtgcttacaaataacaatttacagttggcttg

SEQ ID NO: 49522 - protein, 227 aa, Panicum virgatum
  misc_feature: Ceres CLONE 2050406
  misc_feature (1)..(153): Pfam Name: Pkinase Pfam Description: Protein kinase domain
  misc_feature: SWISSPROT Homolog: EC 2.7.11.1 Non-specific serine/threonine protein kinase
EQILNVVAFCHLQGVVHRDLKPENFLFSTKDEHSPMKIIDFGLSDFIRPDERLNDIVGSAYYVAPEVLHRSYSTEADMWSIGVITYILLCGSRPFWARTESGIFRSVLRADPNFDDTPWQSVSPEAKDFVKRLLNKDYRKRMTAAQALSHPWLRDERRQIPLDMLVFKLVKAYLRSTPLKRAALKALSRAVTEDELIYIRAQYNLLEPNSRDGRICIDNFKMVSAYK

SEQ ID NO: 49523 - DNA, 680 bp, Panicum virgatum
  misc_feature: Ceres CLONE 2050419
  misc_feature: Encodes the peptide sequence at SEQ ID NO. 49524
atcgcccacgttgagacacgagttcctccctcccacctgggctcccccgcctccacgccgctccgctacgcgcgagccactgacccgcctccgctgcctctcttctcctccggagcccgcctctgcacattagtggaagccgagctgacaacaatctatcaagagttgcttcaacatggatactggctgtttatcatctatgaacattactggagtgagccaagcaagatcttttgcggggcaatttcctacccggagatgctttgcaagtagtcaccttgcaagctttgctgtgaaatctcttgtcttgaggaataaaggaagaagctcacaccgtagacattctgctttgcagattgtctgcaaggattttccaagacctccgctagaaagcacaataaactatttggaagctggacagctctcttcattttttaggaacagcgaacgccccagtaaaccattacaggtcgtgattgctggtgcaggattagctggtctgtcaacagcaaaatatctggcagatgcaggccataaacccatattgcttgaggcaagagatgttttgggcggaaagatagctgcttggaaggatgaagatggagattggtacgagactgggcttcatatcttttttggagcttatcccaacatacagaatttatttggcgagcttggta

SEQ ID NO: 49524 - protein, 168 aa, Panicum virgatum
  misc_feature: Ceres CLONE 2050419
  misc_feature: SWISSPROT Homolog: EC 1.14.99.30 Carotene 7,8-desaturase
MDTGCLSSMNITGVSQARSFAGQFPTRRCFASSHLASFAVKSLVLRNKGRSSHRRHSALQIVCKDFPRPPLESTINYLEAGQLSSFFRNSERPSKPLQVVIAGAGLAGLSTAKYLADAGHKPILLEARDVLGGKIAAWKDEDGDWYETGLHIFFGAYPNIQNLFGELG

SEQ ID NO: 49525 - DNA, 699 bp, Panicum virgatum
  misc_feature: Ceres CLONE 2050442
  misc_feature: Encodes the peptide sequence at SEQ ID NO. 49526
atccaaagttgaagttcacagtgcacacacaccaccacggcaccacaccgcagcaacgatatcaaaagggcttgctgtgtgtgatctgcgctccaacagggcagaggtgacaagtgcattatgtgctccaagaagctggcgaagttcgctatacttgtactactggcgctgctacttctgtgctatggagttggaaacgtccagtgcgttcgtgagaacagcacggacctgcactcactgctagagttcaagcagggcgtcaccagcgatccaaataaagtcctgaactcctggaaaaccaaaatccattactgccggtggagcggagttacgtgcacgccgacgcgaccatggcgcgtcatgaggcttaacctcactggccaaagcttggcaggtgaaatcgccccctctctggcaaatctgacgctccttagtgtgcttgacttgtcctccaatcgcttttttggccagttacctcccctgggtcgtctccaactgctggagaccatttatctgaatgacaattcactcaatgggactatccctgacgcactcacaaactgctccaaactaatcaatttagatctccgtaaaaatcagctatcgggtacaatccctccgcaaatagactccctttccaatctagaatatctagacctcaccgacaataatcttactggaacaatccctcccaccttg

SEQ ID NO: 49526 - protein, 192 aa, Panicum virgatum
  misc_feature: Ceres CLONE 2050442
  misc_feature (33)..(73): Pfam Name: LRRNT_2 Pfam Description: Leucine rich repeat N-terminal domain
  misc_feature: SWISSPROT Homolog: EC 2.7.11.1 Non-specific serine/threonine protein kinase
MCSKKLAKFAILVLLALLLLCYGVGNVQCVRENSTDLHSLLEFKQGVTSDPNKVLNSWKTKIHYCRWSGVTCTPTRPWRVMRLNLTGQSLAGEIAPSLANLTLLSVLDLSSNRFFGQLPPLGRLQLLETIYLNDNSLNGTIPDALTNCSKLINLDLRKNQLSGTIPPQIDSLSNLEYLDLTDNNLTGTIPPT

SEQ ID NO: 49527 - DNA, 689 bp, Panicum virgatum
  misc_feature: Ceres CLONE 2050459
  misc_feature: Encodes the peptide sequence at SEQ ID NO. 49528
aaagaatgccactgcggcttcacgcgcgtcgtctccttccccccgctcctcctcctcctcctctccctagatcaagcccccgcattccctccctcctccctccagatcgcggcaaccgcctggccagacattctcctcctcgggacgggcgacgaccagtcccgccggccatgacaccccgcggcgcgccggcgctgctgctggtgctggcgctcgcgctgctcgggctcctgcccccgcgccccgcggcggcgcagcaggagggcgccgtgccggaggcgtacgcggcctcgttcgcggcccgctttgccgcgccgccgtcctggtccttcccgaacccgcgcctccgcgccgcctacgccgcgctccaggcctggaagcgcaccgccatcttctccgacccctccaacttcaccgccaactggtccggccccaacgtctgcgcctacagcggcgtcttctgcgcgcccctccccggcgccgccggcgggtacggccacggcgacctcgtcgtcgccggcatcgacctcaaccacgccgacatcgccgggtacctgccggcgtcgctgcccctcggcgtccccgacctggcgctcttccacatcaactccaaccgcttctgcggcgtcgtcccggacaccttccgccacctgcgcctgctccacgagctcgacctcagcaacaaccgc

SEQ ID NO: 49528 - protein, 172 aa, Panicum virgatum
  misc_feature: Ceres CLONE 2050459
  misc_feature: SWISSPROT Homolog: EC 2.7.11.1 Non-specific serine/threonine protein kinase
MTPRGAPALLLVLALALLGLLPPRPAAAQQEGAVPEAYAASFAARFAAPPSWSFPNPRLRAAYAALQAWKRTAIFSDPSNFTANWSGPNVCAYSGVFCAPLPGAAGGYGHGDLVVAGIDLNHADIAGYLPASLPLGVPDLALFHINSNRFCGVVPDTFRHLRLLHELDLSNN

SEQ ID NO: 49529 - DNA, 491 bp, Panicum virgatum
  misc_feature: Ceres CLONE 2050463
  misc_feature: Encodes the peptide sequence at SEQ ID NO. 49530
actgtgttccggcttcgccgcccgctccctgctgctcgggcggaggcgactagccgacgacttcgtgttccgtcccgcgccgcccgacactcttcgagttccggatcggctaggtagcctgctcgcgcgggccatcgctttctgtcgccatggaggctgcgccggcggcggtcttggagcgggagcgcctcccggccgagatggccttccgcgagcccaaggggggcgagccggcgcccagcatcttcctcacgatccgccgccggttcccggacttcacgcggaacatgcagctcctgtgcgtcaagctcgggatccgcctcggcggcagcccctcttcggctgctgcggatgctctgtcgtgcccgcgctcgccgcctgcgcctactccgtcgaccacttctccgtattcgagtactccgtccacctgctctgctgcgtcccctggctcggcgccgcggcgctgctcgtcctcgtgtactactgcccgc

SEQ ID NO: 49530 - protein, 113 aa, Panicum virgatum
  misc_feature: Ceres CLONE 2050463
  misc_feature: SWISSPROT Homolog: EC 2.3.1.119 Icosanoyl-CoA synthase
MEAAPAAVLERERLPAEMAFREPKGGEPAPSIFLTIRRRFPDFTRNMQLLCVKLGIRLGGSPSSAAADALSCPRSPPAPTPSTTSPYSSTPSTCSAASPGSAPRRCSSSCTTA

SEQ ID NO: 49531 - DNA, 677 bp, Panicum virgatum
  misc_feature: Ceres CLONE 2050474
  misc_feature: Encodes the peptide sequence at SEQ ID NO. 49532
acttccacttccaccgcgccgtggtttccactccttcatcctcctccaccgccaccaatcccaaccctaatccgcgctcaacaaaccctagctctgagatccacccacttcctacgcatgccgcgcttcctccggtggctgcaccggccgagctaagccagacagccggtccccactcaccgccgcggccgccgttgcagctgcagccgccgccatgggctgcgtctgcggccgcccctcctccgccttcgacgacggccagtgccgcacaacgcctccgccggccgcgaagctctcggcggcagtgaggagggaggaggaggcgcggaagcagcagcagcagcagcagcagcatgccagggcgggtagcgggagggaggaggcgctggagaggaggcgggcgatgatggcgatggcggcggcgtgccaggtcaggagcccggtgcccagggtagtggagggggagcaggtggccgcagggtggccgccgtggctcgtcgccgttgccccggaggccgtgcgcggatgggtgccgcgccgcgccgaatcgttcgagaagctcgacaagattggtcagggtacatacagtaatgtttacagagctcgtgatctcgaaaaagagaagattgttgctttgaagaaagtacgatttgataatttggaacctgagagcgtga

SEQ ID NO: 49532 - protein, 154 aa, Panicum virgatum
  misc_feature: Ceres CLONE 2050474
  misc_feature: SWISSPROT Homolog: EC 2.7.11.22 Cyclin-dependent kinase
MGCVCGRPSSAFDDGQCRTTPPPAAKLSAAVRREEEARKQQQQQQQHARAGSGREEALERRRAMMAMAAACQVRSPVPRVVEGEQVAAGWPPWLVAVAPEAVRGWVPRRAESFEKLDKIGQGTYSNVYRARDLEKEKIVALKKVRFDNLEPESV

SEQ ID NO: 49533 - DNA, 738 bp, Panicum virgatum
  misc_feature: Ceres CLONE 2050486
  misc_feature: Encodes the peptide sequence at SEQ ID NO. 49534
agcatagtcgcatccaattccaaaaccagcggagaagagagcagccgcggagaagggaagaagccgccatggccaacgggctcccggaccctccctgcggccttctcaccgccgacgccgctcgatccctcgtcgattccgtcgacgccttcctcttcgattgcgatggggttatttggaagggggataagctcattgaaggggtcggggagacgatggagctgctgcggaaaatgggtaagaaaatagtttttgtaacaaacaactctagaaagtcaagaaggcaatactcaaagaaattcagatcacttggacttgaagtcactgagaaagagatttttacatcctcatttgcggcagccatgttcttgaagttaaataatttccccccagaaaagaaggtttatgttgtcggtgaagacggaattttggaagagctcaagttagctggttttgaatgctttggaggtccggaggatggcaagaaaaacataatcttggaggcggacttctactttgaacatgacaaaagtgttggagctgttgttgttggacttgatcagcacttcaattattacaaaatgcagttacttgcctaaccttggtgtctataccttatctttgttgttatgcattctgatcaatctatactttacttttactctcaagagagctcaatcacagcacataaggcgtgacaccttgttctctcaccctctcaagagctaaccgagcact

SEQ ID NO: 49534 - protein, 176 aa, Panicum virgatum
  misc_feature: Ceres CLONE 2050486
  misc_feature: SWISSPROT Homolog: EC 3.1.3.41 4-nitrophenylphosphatase
MANGLPDPPCGLLTADAARSLVDSVDAFLFDCDGVIWKGDKLIEGVGETMELLRKMGKKIVFVTNNSRKSRRQYSKKFRSLGLEVTEKEIFTSSFAAAMFLKLNNFPPEKKVYVVGEDGILEELKLAGFECFGGPEDGKKNIILEADFYFEHDKSVGAVVVGLDQHFNYYKMQLLA

SEQ ID NO: 49535 - DNA, 597 bp, Panicum virgatum
  misc_feature: Ceres CLONE 2050530
  misc_feature: Encodes the peptide sequence at SEQ ID NO. 49536
aggctaagtgtccatccacaacatacatcttgcaaacaacatactaacaatctcgtctctgtagcatttgaagaactccaacgaaaatgaactcggtggtgaagatcggcccctttggcagcacctccgaggctgagggcaatcgcgacatcaccgtagcgccgctgcgcctggagagcatcaccatccgccatgggaatgtgctcgacgccctctccttcacctacaaggactgccacgggctgcagcacaccacaggccaatggggcggcgatggcggcaactccaccacagtgcagattacccttggccctgacgagttcgtgacgggagttcacgggctctacggcttctacggttacgggagcgacggcgtcaccggcttcaccatcgtcaccaacctccggacctacggaccgttcggagtcagtgactccatcaaggaacccaagtccttcgacatccccgtcatgaacaacggcagcatcgtcggcttcttcgcccaccgcaacaaggtctacgtcacggccatcggtgtctacgtcaagcccttctgatgattgtcatgtgcttgtcaaaatcgatcatgaacctgct

SEQ ID NO: 49536 - protein, 156 aa, Panicum virgatum
  misc_feature: Ceres CLONE 2050530
  misc_feature (18)..(155): Pfam Name: Jacalin Pfam Description: Jacalin-like lectin domain
MNSVVKIGPFGSTSEAEGNRDITVAPLRLESITIRHGNVLDALSFTYKDCHGLQHTTGQWGGDGGNSTTVQITLGPDEFVTGVHGLYGFYGYGSDGVTGFTIVTNLRTYGPFGVSDSIKEPKSFDIPVMNNGSIVGFFAHRNKVYVTAIGVYVKPF

SEQ ID NO: 49537 - DNA, 681 bp, Panicum virgatum
  misc_feature: Ceres CLONE 2050569
  misc_feature: Encodes the peptide sequence at SEQ ID NO. 49538
agagcgagaacctcgccggcggccgggaccgggaggttggttggttcactagccgctgcggccgcggcgatgacggccaccggcggctgctgctcgaccccactcgcgtgggcgcggcctcgcgcctctcccgccccgcgcgtcggccggtgtcgcgcggtcgcggccggggcgtctgacgtggcgttccacccggacgtgtcccgcgcggcggagtcgctgcaggcggagttccgcgccgtcgaccgagccctcgccctcaactcctcccgcgtcgccgccgccttccgccgcgcccgcgtcgccccgcaccatttcggcgggtcgacggggtacggccacgacgatggcggcggccgggaggcgctggacgccgtattcgctgaaatcgtcggcgccgaggccgccattgtgcgcccccagttcttctccggcacgcacgccattgcctgtgcgctatttgcgcttctgaggcctgggcatgagctcctggcagtcgctgggcctccgtacgacaccttagaggaggtgattgggatcagggggtcggctaatgtatggtcactcaaaagactttggagtggcataccgagaaattccggtctgttggtatctcccttagaatacattaagatgggtgactgtcttgcctcgtgctgaggagtgaggacgggttactga

SEQ ID NO: 49538 - protein, 196 aa, Panicum virgatum
  misc_feature: Ceres CLONE 2050569
  misc_feature (40)..(194): Pfam Name: Alum_res Pfam Description: Aluminium resistance protein
MTATGGCCSTPLAWARPRASPAPRVGRCRAVAAGASDVAFHPDVSRAAESLQAEFRAVDRALALNSSRVAAAFRRARVAPHHFGGSTGYGHDDGGGREALDAVFAEIVGAEAAIVRPQFFSGTHAIACALFALLRPGHELLAVAGPPYDTLEEVIGIRGSANVWSLKRLWSGIPRNSGLLVSPLEYIKMGDCLASC

SEQ ID NO: 49539 - DNA, 645 bp, Panicum virgatum
  misc_feature: Ceres CLONE 2050576
  misc_feature: Encodes the peptide sequence at SEQ ID NO. 49540
acaccgatcactcgctgctcccctccctcgccggagcccagggatggcggcagcagctcctcccgccgccgcgatcgcgtgatggaagccgacgccgccgctctccgccgatggacgacgctggaagggcatccgctcccgcggcggtgacagtctccgccaccgccgcacccgtgcatcccccgccctccgccaccgccgccgacacgccctcccccgacccctccgcgctctatggagaggggatgtgggaacagatggccatgaacagcggtgccacaatgcaacctgggccatatcctgagcggcagggtgaaccggactgcacctactatctcaggactggattgtgtagatttggcatgagctgcaggttcaatcatcctccggataggaatctggctatggcctctgccagaatgaagggagaatatcctgagagattgggacaaccagaatgccagtattatctgaagacaggaacatgcaagtttggccctacatgcaaatttcaccatcccagggaaaaggctggaattgcaggaagggtgcagctaaacacattaggatatccactccgcccgaacgaaaaggagtgtgcatattatttaaaaacaggacagtgtaaatatgcgaatacttgta

SEQ ID NO: 49540 - protein, 178 aa, Panicum virgatum
  misc_feature: Ceres CLONE 2050576
  misc_feature (112)..(138): Pfam Name: zf-CCCH Pfam Description: Zinc finger C-x8-C-x5-C-x3-H type (and similar)
  misc_feature (67)..(93): Pfam Name: zf-CCCH Pfam Description: Zinc finger C-x8-C-x5-C-x3-H type (and similar)
  misc_feature: Functional homolog of the protein sequence given in SEQ ID NO 50340
  misc_feature: Useful for making plants with modulated nitrogen use efficiency
  misc_feature: Functional homolog of the protein sequence given in SEQ ID NO 50341
  misc_feature: Useful for making plants with modulated low light sensitivity
  misc_feature: Functional homolog of the protein sequence given in SEQ ID NO 50342
  misc_feature: Useful for making plants with altered alkaloid content
  misc_feature: Useful for making plants with altered lignin content
  misc_feature: Useful for making plants with altered terpenoid content
  misc_feature: Useful for making plants with modulated flowering time
MDDAGRASAPAAVTVSATAAPVHPPPSATAADTPSPDPSALYGEGMWEQMAMNSGATMQPGPYPERQGEPDCTYYLRTGLCRFGMSCRFNHPPDRNLAMASARMKGEYPERLGQPECQYYLKTGTCKFGPTCKFHHPREKAGIAGRVQLNTLGYPLRPNEKECAYYLKTGQCKYANTC

SEQ ID NO: 49541 - DNA, 674 bp, Panicum virgatum
  misc_feature: Ceres CLONE 2050588
  misc_feature: Encodes the peptide sequence at SEQ ID NO. 49542
atatttcgacgggcacgagccccctcgcctcatctggccccgtgcggcggcggcgacgactccacctgacctggcctgcggcgacgactcctcaatcctcatctgtccttctctgaccgtcgggtatcggccagatccgtgggggcgccgtgttctgcggaggacctagatcgcatcgcgtgcgatgccgcgcgacttgtcacggtcgcgttctccgccgcgccggcggcagcggtcgccgtcccccgcgcggtaccgcggccggagagggcgccgggaccgaagcccaagccccgtccgtagcagatccccctatcgccccgcgtataggtgacctcagctacactctcgcaccaccacagaaatctggcgactcttttctttatttatttatttaggttgtatactgtaaaaaaacatgaggtgttgctagtccgcttatggaatttttatactgtacagtttatttgatggaaatgggacgtgcgcttctgcatatagttattggatctatcaattattgtttgagctagctagtgtggtagtatgttgtggtataccatatttcaatcaattattttttctatgaacatgtgtgatgttgaccatgcttgagaacgatacagattcccaggaaaaaaattactttggttcctttgctgtgcagagtggat

SEQ ID NO: 49542 - protein, 49 aa, Panicum virgatum
  misc_feature: Ceres CLONE 2050588
  misc_feature: Functional homolog of the protein sequence given in SEQ ID NO 50750
  misc_feature: Useful for making plants with modulated flowering time
  misc_feature: Functional homolog of the protein sequence given in SEQ ID NO 51759
  misc_feature: Useful for making plants with altered alkaloid content
  misc_feature: Functional homolog of the protein sequence given in SEQ ID NO 50813
  misc_feature: Useful for making plants with modulated biomass
MPRDLSRSRSPPRRRQRSPSPARYRGRRGRRDRSPSPVRSRSPYRPAYR

SEQ ID NO: 49543 - DNA, 649 bp, Panicum virgatum
  misc_feature: Ceres CLONE 2050594
  misc_feature: Encodes the peptide sequence at SEQ ID NO. 49544
aaggtgccaaccactcccctctcgaaggcgaccaagaaagaactccagcagcagcagctctgtagcgtccgactcccctccttttccccgcgtctcctctgagctccggcgaaagcccgccgccgccgccgtggccggacttccgatggcaactcctcggaagccgatcaagctcaccctgccgtcccacgagaccgccataggcaaattcctgacgcaaagcgggacgttcagggacggggatctgctcgtcaacaaggatggcctccgtatcgtttcgcagaacgagggaggcgaggtaagccacctggactgaggattaaaagttgcgtctttgcatcatccgtctgaaaatcttaggattggaatcgccaaattggctattgtaatgaggtttctcttgatgatgagataaacatagtaagcaattgatgtgatccatgttatacagtcgtccgactaatcgcgattagtcgcgattagtcgaccttatcgctccgctggcttcgataagtgaaacgactagcttttgtcgatcagatgtctgatcgtccgactaatcgtcgcctaatcgcgattagtcgtccgactagctacttggacgatcaggccaaaaccaaaagatgtccagcaaaccagcactccagcc

SEQ ID NO: 49544 - protein, 56 aa, Panicum virgatum; identical to SEQ ID NO: 49282
  misc_feature: Ceres CLONE 2050594
  misc_feature: SWISSPROT Homolog: EC 2.7.12.2 Mitogen-activated protein kinase kinase

SEQ ID NO: 49545 - DNA, 603 bp, Panicum virgatum
  misc_feature: Ceres CLONE 2050613
  misc_feature: Encodes the peptide sequence at SEQ ID NO. 49546
aagcgagggggcagacgccgacatgtggtgcctggtcgcgctcccaccgatggcccgggccggccggcggcggccgtcgacttcagtcccccgccgcggccgcaccctcgccgccctcccttgcggctgccgctgcggccggcggcacctcatcggtgcctcctcagctgccgccctcatccctctcctcacccctcgctccccggccgcgccgcccatcgaccccgaggtgatgctcgagcgagtgcacccgtcgaggccggactggtacgaggagttctatgccacggccatggaccagggaatgaagtcatacgaagcagagattgcaggatataaagcaaagctcttttcccaattgtcggctacaggaaagaacattctggagcttggtgttggaacgggccctaacttcaaatattatgcaagcaacgttggggttaatgtaattggcgtggatcctaacaagcacatggaggactatgccagaacagcagcagtatctgcaggacttccatcatcaagcttcactttcaaaagaggggttgctgaagctttgccagtagaggacaattccatggatgctgttatcggcacactggt

SEQ ID NO: 49546 - protein, 193 aa, Panicum virgatum
  misc_feature: Ceres CLONE 2050613
  misc_feature: SWISSPROT Homolog: EC 2.1.1.41 Sterol 24-C-methyltransferase
MWCLVALPPMARAGRRRPSTSVPRRGRTLAALPCGCRCGRRHLIGASSAAALIPLLTPRSPAAPPIDPEVMLERVHPSRPDWYEEFYATAMDQGMKSYEAEIAGYKAKLFSQLSATGKNILELGVGTGPNFKYYASNVGVNVIGVDPNKHMEDYARTAAVSAGLPSSSFTFKRGVAEALPVEDNSMDAVIGTL

SEQ ID NO: 49547 - DNA, 650 bp, Panicum virgatum
  misc_feature: Ceres CLONE 2050638
  misc_feature: Encodes the peptide sequence at SEQ ID NO. 49548
aacttcgagtttactacttgtacccctcatccactcgcttgtaccagcatcactacactgttgcagaattgtagtagccaccgcaagcactagctaatcgagagttagaaaccgatggacgacgtcgtcgcagcagcagcagcttcggcatcgccgtggagcctgctacttccggggcttctcacccttctcgtcgcgtgggtttcctaccgcgccgcggagagatgctggctgcggccgcagcggctgagccgggctctccgggcgcaggggctcggcggcacggcgtacagcttccccgccggcgacctcaaggagaacgcccggctcaacaacgaggcgaggtccaagcccatgccgccgtgccatgacgttgttccacgcgtgatgccgcatctcctcaacactgtcaaggagcacggcaacatttgcattacctggttcggcccaatcccaagggtgattatcggagaggcagagttagtgagagacatcctttcaaacaagttcggtcacttcgagaagttcacgaacaaacgtctgggaaagctgctagcgcttgggcttgcgagcatagacggcgagaaatggggcaagcacaggaggatcctgaaccctgcattccatctagaaaagctcaagcgcatgat

SEQ ID NO: 49548 - protein, 178 aa, Panicum virgatum
  misc_feature: Ceres CLONE 2050638
  misc_feature: SWISSPROT Homolog: EC 1.3.3.9 Secologanin synthase
MDDVVAAAAASASPWSLLLPGLLTLLVAWVSYRAAERCWLRPQRLSRALRAQGLGGTAYSFPAGDLKENARLNNEARSKPMPPCHDVVPRVMPHLLNTVKEHGNICITWFGPIPRVIIGEAELVRDILSNKFGHFEKFTNKRLGKLLALGLASIDGEKWGKHRRILNPAFHLEKLKRM

SEQ ID NO: 49549 - DNA, 659 bp, Panicum virgatum
  misc_feature: Ceres CLONE 2050669
  misc_feature: Encodes the peptide sequence at SEQ ID NO. 49550
ggctagcgaaccagaaaaaatcgcccccgccctgccgtgtctccgctcccgcatccccaagcggagctctcgctttcggcgcgcgctcccgtccggcccccgcatcctccagggcgccccatgagctgaggccgccgccgatgggcccgccccccgccgcgcaggaccccgcgccgtcgccgtcgagcggcagcggctcctccaggcgccgcctccgccggctcgaccgccgcaacgcgtccaagaacatcggctacgacgccaccaacttctgccagttcccgctgtccccgcagccggcctccgcgccggcgtcggggccggcctcgctcgccggctccgcggccggcgcgctggacggcggcgacagcttccgcatcggcggcagcggcgacggcggcggggacgtccagctcctctgccagagcctcggcctctccggccccgacgacttcgccatcccgctcgccgactgggaggcgcacaaggccgtgcgctcctcggcctccgcctccacctcccctgcgtccgcgcggcacaaacccgaaccccccgcgcgggactccccgctccgccacgagggcgccgacgagcccacccggccagcggacgccgaccacgagctaccggcgaaggagccggccgcgagggacgcccca

SEQ ID NO: 49550 - protein, 172 aa, Panicum virgatum
  misc_feature: Ceres CLONE 2050669
  misc_feature: SWISSPROT Homolog: EC 2.7.11.25 Mitogen-activated protein kinase kinase kinase
MGPPPAAQDPAPSPSSGSGSSRRRLRRLDRRNASKNIGYDATNFCQFPLSPQPASAPASGPASLAGSAAGALDGGDSFRIGGSGDGGGDVQLLCQSLGLSGPDDFAIPLADWEAHKAVRSSASASTSPASARHKPEPPARDSPLRHEGADEPTRPADADHELPAKEPAARDA

SEQ ID NO: 49551 - DNA, 661 bp, Panicum virgatum
  misc_feature: Ceres CLONE 2050674
  misc_feature: Encodes the peptide sequence at SEQ ID NO. 49552
gaagacacggacagggcccctgagaagactcttccccgcttcgctcctcttcgtctcctcctcgccgctgcggccgcgcgggccgtcgccggcgggtgggttagtgcggccgggtgaggcgctcggacctcggaggagctaggggacgcggcggctcgcgctgatttggggagttctggaggcgatgcgaggtctcggacgggtgttgcggtgggcttcctgctgcaagctgtcggacgggggcgaaccgggtaggaggaagaagaagggcgcaacatggcgcatcttctcgctaaaggagcttcagtcggcgacgaacaatttcaattacgacaacaagcttggtgagggtgggttcggcagcgtctactggggccagctctgggatggatcgcaggtgttgtttctcttgaactatgaaccacaggaatcttcattctgctctgtgcaacctttttttcccttgcatgccgcagttttagattctgggcttttggtattgttggtaggaacaggacaattggaaagacctgctgatgttgatgattgtatcttagctgatttaacttcaccatgtcgcactatttctgtttctagtagttttcagagctgttctatgcaggggcgaagctagctggaaatgacgctggtgcaccgctta

SEQ ID NO: 49552 - protein, 149 aa, Panicum virgatum
  misc_feature: Ceres CLONE 2050674
  misc_feature: SWISSPROT Homolog: EC 2.7.11.1 Non-specific serine/threonine protein kinase
MRGLGRVLRWASCCKLSDGGEPGRRKKKGATWRIFSLKELQSATNNFNYDNKLGEGGFGSVYWGQLWDGSQVLFLLNYEPQESSFCSVQPFFPLHAAVLDSGLLVLLVGTGQLERPADVDDCILADLTSPCRTISVSSSFQSCSMQGRS

SEQ ID NO: 49553 - DNA, 704 bp, Panicum virgatum
  misc_feature: Ceres CLONE 2050691
  misc_feature: Encodes the peptide sequence at SEQ ID NO. 49554
aggatagctcgagctctgctgattgacagccctcccgcagtcccgctcaaagactctgtcctcccttgctcttcctttcttggcggcgacgactgggcgagcggcggcaccatttgtcaggtcttcgcccagcctttgccggcgacgagcatcgtccagaagagtgttgctctccagggtaggcgtggtagctttataaatctcaatgagggagggttcccaggatattgagagcaaggaaaaggtacagtcattggtacatggtggtaatgaagagcaagctgaacagctaaatacaagagtcactggtgcacatcaaggagattctggtttgttatcagcttctagtaatgataataagaaggtttctcgtgaagacattgaacttgttcagaatcttatagagcgttgtttacagctatatatgaataaaggagaagttgttagaactctttctaatcgtgcacgaatagaacctggtttcacaacattagtgtggcaaaagcttgaagaagagaattctgagttctttcgggcttactacataaggctgaaattgaaaaaacagattaacctgtttaaccatttattggaacatcaatacaatctaatgaagtacccagtaccccagcaggttccatgtgctccaaggcccaatggaattcatcctatgcccgttaacaatatgccaatgggataccctg

SEQ ID NO: 49554 - protein, 166 aa, Panicum virgatum
  misc_feature: Ceres CLONE 2050691
  misc_feature: Functional homolog of the protein sequence given in SEQ ID NO 50273
  misc_feature: Useful for making plants with modulated water use efficiency
  misc_feature: Functional homolog of the protein sequence given in SEQ ID NO 50274
  misc_feature: Useful for making plants with modulated drought sensitivity
MREGSQDIESKEKVQSLVHGGNEEQAEQLNTRVTGAHQGDSGLLSASSNDNKKVSREDIELVQNLIERCLQLYMNKGEVVRTLSNRARIEPGFTTLVWQKLEEENSEFFRAYYIRLKLKKQINLFNHLLEHQYNLMKYPVPQQVPCAPRPNGIHPMPVNNMPMGYP

SEQ ID NO: 49555 - DNA, 675 bp, Panicum virgatum
  misc_feature: Ceres CLONE 2050701
  misc_feature: Encodes the peptide sequence at SEQ ID NO. 49556
atctcttcccgagtcttctccttccccgctttgccaccgttttggtgaaccaccctctcaaccaatccaagcaaaaccagcaccaccattgacatcgccactgccacagcacctcctcttcttaacctccacccatgtatgctgcatgccacggcatcagcacgcctcgccagtcacctccaccgccatggccggcaatggcgcgcctcgccttctccggctccctaccgctgccacctcgttgccgctgcagcagctagcagtagcagtcctgctacagctgctgtgcctcgcctcggcgcttaaccaggacggcatgctgctcctctccttcaagctctcgctcgccgccgacccgctcggctccctctccggctggggctacgccgacgccacgccctgcgcgtggaacggcgtcgtctgctcgccggactcgcgggtcgtcagcgtcgtcctccccaacgcgcagctcgtcggccccgtggccaaggagctcggcctcgtcgagcacctccggcacctcgacctctccgggaacgcgctcaacggcaccatcccgcccgagctgctccgcgcgccggagctccgagtgctctcgctcgccggcaatggcattaccggcgaccttccggagcaggtcggccagcttcgcagcctccgcgcgctcaaacctcg

SEQ ID NO: 49556 - protein, 162 aa, Panicum virgatum
  misc_feature: Ceres CLONE 2050701
  misc_feature (39)..(80): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGNGAPRLLRLPTAATSLPLQQLAVAVLLQLLCLASALNQDGMLLLSFKLSLAADPLGSLSGWGYADATPCAWNGVVCSPDSRVVSVVLPNAQLVGPVAKELGLVEHLRHLDLSGNALNGTIPPELLRAPELRVLSLAGNGITGDLPEQVGQLRSLRALKP

SEQ ID NO: 49557 - DNA, 527 bp, Panicum virgatum
  misc_feature: Ceres CLONE 2050707
  misc_feature: Encodes the peptide sequence at SEQ ID NO. 49558
actcctgcgcgcctccctcttctcctcctgttcgccattagagcgcgcgccctcgcacgcctgcggcggcgaagcttctagatttttcaagatgaaggtgatcgagaagatccatgaggcggcggcggatggacggacgctgttctcgttcgagttcttcccgcccaagacagatgagggagtcgagaacctgttcgagcggatggaccgcatggtggcacacggcccgtccttctgcgacatcacctggggcgccgggggatccaccgccgacctcactctcgaaatcgccaatcgtatgcagaacatggtgtgtgtggaaactatgatgcacctgacatgcacaaacatgccagttgagaagattgaccatgctttggaaaccatcaagtccaatgggattcaaaatgttttggcactcagaggagatcctccacacgggcaagacaaatttgtgcaagttgagggcggatttgcttgtgctcttgatctggtgcagcatattagagccaaatatggtgattatt

SEQ ID NO: 49558 - protein, 145 aa, Panicum virgatum
  misc_feature: Ceres CLONE 2050707
  misc_feature (6)..(144): Pfam Name: MTHFR Pfam Description: Methylenetetrahydrofolate reductase
  misc_feature: SWISSPROT Homolog: EC 1.5.1.20 Methylenetetrahydrofolate reductase (NAD(P)H)
MKVIEKIHEAAADGRTLFSFEFFPPKTDEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDY

SEQ ID NO: 49559 - DNA, 474 bp, Panicum virgatum
  misc_feature: Ceres CLONE 2050714
  misc_feature: Encodes the peptide sequence at SEQ ID NO. 49560
acgcacactcgcctctccgctgccactcgcactccgcatcgcgcaagcaagcagcagacagggcgaacaaaaactgcccccccccccccatgcggccgcatcttcttcctctgtggctactggaaatgcaccccaaccactgatccggttgacaagattgtcccatctctgaattaactaccgtttccttctccacatgttgttgaggtccttgtcctccctccttatgtgttccttcctgtggtcatgagccagctgcgcccagatttcctagttgctgctcagaactgctgggtgaaaaagggtggtgctttcactggtgaagtcactgctgagatgctcgtcaaccttggcgttccctgtgtcattcttggacactctgaaaggagggctctgttgggagaatcaactgagtttgttggagacaatgttgcctatgctctctctcacggactaaatgtcattgcatgtgtt

SEQ ID NO: 49560 - protein, 75 aa, Panicum virgatum
  misc_feature: Ceres CLONE 2050714
  misc_feature: SWISSPROT Homolog: EC 5.3.1.1 Triose-phosphate isomerase
  misc_feature: Functional homolog of the protein sequence given in SEQ ID NO 50215
  misc_feature: Useful for making plants with modulated biomass
MSQLRPDFLVAAQNCWVKKGGAFTGEVTAEMLVNLGVPCVILGHSERRALLGESTEFVGDNVAYALSHGLNVIAC

SEQ ID NO: 49561 - DNA, 670 bp, Panicum virgatum
  misc_feature: Ceres CLONE 2050722
  misc_feature: Encodes the peptide sequence at SEQ ID NO. 49562
agcccgcccccgcctccatccacagcggccacgcccgctcccccctcccctcccctctccctagtccctcctcgtccccggacgcggcgtgcccgtccgtcagccaccgactccctcccccaccgccccgatccggagccgagtcgcccttgctcaggaggcagagagccccgaaccgcggcgggagggagggcggccttcctcttagcttccaccccgccggaggccagccgccccatgggccggtcgcccgcgcgcgctacgtaccagctcatcgaccgccggaaagggcttgggtaactctttgttgaaagaacctctcttgtacatgtaacattgcatgtaatttctgttaaagatgagttctctgaataaagttgtttcaaatagtggggatgtgtgttcggtgttacctagtaaagcaacatcattaaatcccaatgcagcagaattcgtaccttcgtttattaaaccatctgttggaaatagcacagctccagatgtagctaagtcagattttagggggtcttctggaaaaacaatcctagataggtccgagtcttcaaagtctaataactcggatgatgaggcacaccagttttggcgcaagcagcttccagatgacattattccagacttctcttcatttgagaaaattgaacaagggcct

SEQ ID NO: 49562 - protein, 103 aa, Panicum virgatum
  misc_feature: Ceres CLONE 2050722
  misc_feature (20)..(37): Pfam Name: PAM2 Pfam Description: Ataxin-2 C-terminal region
MSSLNKVVSNSGDVCSVLPSKATSLNPNAAEFVPSFIKPSVGNSTAPDVAKSDFRGSSGKTILDRSESSKSNNSDDEAHQFWRKQLPDDIIPDFSSFEKIEQG

SEQ ID NO: 49563 - DNA, 695 bp, Panicum virgatum
  misc_feature: Ceres CLONE 2050737
  misc_feature: Encodes the peptide sequence at SEQ ID NO. 49564
acaacctatccagaacaacttgcgcgtgcttctgcagatctcatcagtcctagcttcatttcaccatcttacaaccatggcctttgccggccaagcactcaccgataaccaggaagcctcagaaaggaagcacttcgtgctggttccactgatggcacagggccacactatccccatgactgacatggcacgcctgctagccgagcatggtgcacaggttagcttcatcaccacaccggtgaacgccacaaggatggcagggttcatcaaccacatgcaggcaacgggcctcgcaatccagttcgtcaagctcaacttccccgctgttgagtttggcctgcctaacggatgtgagaatgccgacatgatccagtcaagagatctgtacaagaatttcatggaggcctgcgcagcacttcgggagccacttacagcatacctccatcagcaacacccatctccaagctgcatcatatctgacatgtcacactggtggactgctgacatcgcaagggagtttggtatcccaaggctcacgtttaatggcttctgcgccttcgcatcccttgtaaggtattctatgttgatataaggcaggcgtatgttcttattaaaaatacctgccacccaaaaataggagtgagaagacatagattccttttagaaaagaagcacattagcatacagttaggaac

SEQ ID NO: 49564 - protein, 171 aa, Panicum virgatum
  misc_feature: Ceres CLONE 2050737
  misc_feature: SWISSPROT Homolog: EC 2.4.1.238 Anthocyanin 3'-O-beta-glucosyltransferase
MAFAGQALTDNQEASERKHFVLVPLMAQGHTIPMTDMARLLAEHGAQVSFITTPVNATRMAGFINHMQATGLAIQFVKLNFPAVEFGLPNGCENADMIQSRDLYKNFMEACAALREPLTAYLHQQHPSPSCIISDMSHWWTADIAREFGIPRLTFNGFCAFASLVRYSMLI

SEQ ID NO: 49565 - DNA, 666 bp, Panicum virgatum
  misc_feature: Ceres CLONE 2050748
  misc_feature: Encodes the peptide sequence at SEQ ID NO. 49566
gagactggagtcacgcaaccaccgtcccctcgccggcacgctccgccgctgccgctcctctcctctcctcgttgccacgaccgccgcccgcacgcgcagaaagaaaacagggaaaagaaaaggatcggaagaaacggcaatcccttcactcgtcgcccctccgccgcaatcgccctgcccgcccgccgccgcgtctccccggcgttcttttcctcctccggcccccttgccgcccatgccaagcaacctaaatctctccgcgcggtcttgattccgtcatcccttcctcgaattcctctcccgcaagatatcggttcttcggtaccgaaagatggtcggcggcgacaatgagttccggttcttcttgtcctgcgacatcagcctcccgctcgccttccgcgtcctccacgcagaacatatcctgttgacccagcaaaaggctccagagctctttgttgagtgcaagctatacatggatgggatactatttgggttgcccgtaaagacaaggttggaaccttcaggaccgacgtactgttggaatgagctgataacacttagtaccaagtacagggacctaacttctctctcacaacttgcttttacggtgtgggatgtgtcatctggtgaggaacctgagattgttggtggagctaccatatgcct

SEQ ID NO: 49566 - protein, 111 aa, Panicum virgatum
  misc_feature: Ceres CLONE 2050748
  misc_feature: SWISSPROT Homolog: EC 2.7.1.137 Phosphatidylinositol 3-kinase
MVGGDNEFRFFLSCDISLPLAFRVLHAEHILLTQQKAPELFVECKLYMDGILFGLPVKTRLEPSGPTYCWNELITLSTKYRDLTSLSQLAFTVWDVSSGEEPEIVGGATIC

SEQ ID NO: 49567 - DNA, 618 bp, Panicum virgatum
  misc_feature: Ceres CLONE 2050768
  misc_feature: Encodes the peptide sequence at SEQ ID NO. 49568
attcctccccacccagcccggccgcgcgtccgccccgatcctcgctacccaccaccgcgcatgccagcgccgccgccgatcagcaggcaccaccaccccctcctcctccggcggcggatcagcagtagcttcgactctgagctgttcttgctcctgcggtgactctcgctagttctttctttccctcttcatccgtcgaggtgcgagggaaggaagcttgttgccggcttgaggagggttcgtcggagaccggaaggaaggtcgatcgtcgagcagctaatgcctcccaacgcccaggacgcgcacggaagcaccggcctcgccgtgacggcggccccggcggcggcagcggcgaacaagatggactgcttcctgaccaccgcctgcacgccgctcaacctccagttcatcgacgtgtcgtaccgcgtgaagcagacggagcggtcggcggcggcgccgcccggccggatatcctcgcactccggcgccggcggcgacgcagcggcggaggagcggacgatcctcaggggcgtcacgggcgaggcgcggccgggggaggtgctcgcggtgctgggcccgtcggggagcggcaagtcgacgctgctctccatcctcggc

SEQ ID NO: 49568 - protein, 112 aa, Panicum virgatum
  misc_feature: Ceres CLONE 2050768
  misc_feature (82)..(112): SWISSPROT Homolog: EC 3.6.3.28 Phosphonate-transporting ATPase
  misc_feature (78)..(112): SWISSPROT Homolog: EC 3.6.3.27 Phosphate-transporting ATPase
  misc_feature (82)..(112): SWISSPROT Homolog: EC 3.6.3.17 Monosaccharide-transporting ATPase
MPPNAQDAHGSTGLAVTAAPAAAAANKMDCFLTTACTPLNLQFIDVSYRVKQTERSAAAPPGRISSHSGAGGDAAAEERTILRGVTGEARPGEVLAVLGPSGSGKSTLLSIL

SEQ ID NO: 49569 - DNA, 662 bp, Panicum virgatum
  misc_feature: Ceres CLONE 2050779
  misc_feature: Encodes the peptide sequence at SEQ ID NO. 49570
ctacctgtgttcaagctcttcttgagcacaattttcatcagctcgcctgtggacaaaacatgactgttgcccttgctacatctggtcatgtgtataccatgggtagtgctgacaatggtcagctcggaaatccaaaatctgatggtaaacagccttgtttagtcaaagataaactaggtaatgagttagttgagaagatatcgtgtggagcttcccatgttgcagttctaacgtcacgaagcgaagtatacacatggggcatgggggccaatggaagacttggtcatggtgacatcaatgacaaaaagacaccaaccatcgttgaagcacttaaagatcgacatgtcaaaagtatatcatgtggttcaaacttcacaacatgtatttgcatacataagtgggtgtcaggtgcagatcagtcagtttgcacaggttgtaggcaagcatttggtttcacaagaaagcgacataattgctacaactgtgggctagtacactgtcatgcttgtagttcaagaaaagtgctcaaggctgctttggcaccaactcctggcaagccgcatcgtgtatgtgattcatgtttcctcaaactgaagaatgcagataccaacatcaacaatgttagcaaaagaaatgctcctactcgtcgctctattgatagc

SEQ ID NO: 49570 - protein, 219 aa, Panicum virgatum
  misc_feature: Ceres CLONE 2050779
  misc_feature (27)..(76): Pfam Name: RCC1 Pfam Description: Regulator of chromosome condensation (RCC1)
  misc_feature (81)..(128): Pfam Name: RCC1 Pfam Description: Regulator of chromosome condensation (RCC1)
  misc_feature (131)..(199): Pfam Name: FYVE Pfam Description: FYVE zinc finger
  misc_feature (14)..(121): SWISSPROT Homolog: EC 2.7.11.1 Non-specific serine/threonine protein kinase
  misc_feature (132)..(205): SWISSPROT Homolog: EC 3.1.3.48 Protein-tyrosine-phosphatase
TCVQALLEHNFHQLACGQNMTVALATSGHVYTMGSADNGQLGNPKSDGKQPCLVKDKLGNELVEKISCGASHVAVLTSRSEVYTWGMGANGRLGHGDINDKKTPTIVEALKDRHVKSISCGSNFTTCICIHKWVSGADQSVCTGCRQAFGFTRKRHNCYNCGLVHCHACSSRKVLKAALAPTPGKPHRVCDSCFLKLKNADTNINNVSKRNAPTRRSID

SEQ ID NO: 49571 - DNA, 543 bp, Panicum virgatum
  misc_feature: Ceres CLONE 2050782
  misc_feature: Encodes the peptide sequence at SEQ ID NO. 49572
gtcggggatgggcgtcgccctcatgctcctgagtatactacgcttcctctccaccgccaccgtacttcaagaggaccgatatcccatggttgagtgctataagtatttgacattgaaacagaaaatgccttcctccagggctactcagtgtttcagttcctccatcaggaatcgccacaactcattagccatgatattaggacaaacaacccttgatgctgaactctatgcagagtttgaagaatctggtgattcctttgattactcccagttggttgaagcgcagcgaagcgctccacctgagcggcaagggcgttcagataaagtcatagcatacttgcgtcaaattcaaagaggaaagctaatcccaccatttggttgattgttggcccttgatgagaagagcttcggggttattgcattcagtgagaatgctccggaaatgcttacaacagtcagccatgctgtgcctaatgttgatgattccccaaagctaggaattggtaccaatgagcgctcccttttcactgacccaggtgccac

SEQ ID NO: 49572 - protein, 85 aa, Panicum virgatum
  misc_feature: Ceres CLONE 2050782
  misc_feature: SWISSPROT Homolog: EC 2.7.11.1 Non-specific serine/threonine protein kinase
  misc_feature: Functional homolog of the protein sequence given in SEQ ID NO 51315
  misc_feature: Useful for making plants with modulated biomass
  misc_feature: Useful for making plants with modulated light quality response
  misc_feature: Useful for making plants with modulated light quality sensitivity
MPSSRATQCFSSSIRNRHNSLAMILGQTTLDAELYAEFEESGDSFDYSQLVEAQRSAPPERQGRSDKVIAYLRQIQRGKLIPPFG

SEQ ID NO: 49573 - DNA, 659 bp, Panicum virgatum
  misc_feature: Ceres CLONE 2050790
  misc_feature: Encodes the peptide sequence at SEQ ID NO. 49574
acgtacgttgctcgcacggctcagttccaacccgccatccatggacccctacaagtaccggccgtcgagcgcccacaacggcccgcattggagcaccaactccggcgcgcccgtatggagcaacgaccactccctcaccgtcggaccacgaggcccgatcctgctggaggactaccacctggttgagaagctggccaacttcgaccgcgagcgcatcccggagcgcgtggtgcacgcccgcggcgccagcgccaagggcttcttcgaggtgaccaacgacatctcccacctcacgtgcgccgacttcctgcgcgcccccggcgtgcagacccccgtcatcgtgcgcttctccacggtgatccacgagcgcgggagccccgagaccctgcgcgacccgcgcgggttcgccgtcaagttctacacccgcgagggcaactgggacctcgtcggcaacaacttccccgtcttcttcgtccgcgacggcatgaagttccccgacatggtgcacgccctcaagcccaaccccaagacccacatccaggagaactggcgcatcctcgacttcttctcgcaccacccggagagccctcacatgttcaccttcctcttcgacgacgtcggcatccccgccgactaccggcacatggacggctccggcg

SEQ ID NO: 49574 - protein, 206 aa, Panicum virgatum
  misc_feature: Ceres CLONE 2050790
  misc_feature (18)..(206): Pfam Name: Catalase Pfam Description: Catalase
  misc_feature: SWISSPROT Homolog: EC 1.11.1.6 Catalase
MDPYKYRPSSAHNGPHWSTNSGAPVWSNDHSLTVGPRGPILLEDYHLVEKLANFDRERIPERVVHARGASAKGFFEVTNDISHLTCADFLRAPGVQTPVIVRFSTVIHERGSPETLRDPRGFAVKFYTREGNWDLVGNNFPVFFVRDGMKFPDMVHALKPNPKTHIQENWRILDFFSHHPESPHMFTFLFDDVGIPADYRHMDGSG

SEQ ID NO: 49575 - DNA, 675 bp, Panicum virgatum
  misc_feature: Ceres CLONE 2050798
  misc_feature: Encodes the peptide sequence at SEQ ID NO. 49576
agccttcgcgcatttcccttccctccgccgccgccgccgccgcagcccgcagccgcattcgccatgggggcatacacgtacgtgtcggagctatggaggaagaagcagtcggacgtgatgcggttcgtgcagcgcgtgcggtgctgggagtacaggcagcagccggcgatcgtccgcctcaccaggcccacccgccccgacagggctcgccgccttggctacaaggccaagcagggctatgttgtgtaccgtatccgtgtcaggcgtggtggcaggaagaggcctgtgcctaagggtattgtatatggcaagcccaagcaccagggtgtcacccagctcaagttccagaggaacaagaggtctgttgctgaggagagagctggacggaagcttggtgggctgagggttctcaactcctactgggtgaatgaggacagtacctacaagtactttgaggtcatccttgtggatgttcaccacaaggccatccgcaacgacccaaggatcaactggctttgcaatcctgtgcacaagcaccgtgagctccgtggtctcacctctgcgggcaagaagttccgtggtctgcgtggcaagggcaccactcaccacaagaacaggccgtcaaggagagccacctggaagcgcaaccagaccctctccctccgccgctaccgt

SEQ ID NO: 49576 - protein, 203 aa, Panicum virgatum
  misc_feature: Ceres CLONE 2050798
  misc_feature (2)..(193): Pfam Name: Ribosomal_L15e Pfam Description: Ribosomal L15
MGAYTYVSELWRKKQSDVMRFVQRVRCWEYRQQPAIVRLTRPTRPDRARRLGYKAKQGYVVYRIRVRRGGRKRPVPKGIVYGKPKHQGVTQLKFQRNKRSVAEERAGRKLGGLRVLNSYWVNEDSTYKYFEVILVDVHHKAIRNDPRINWLCNPVHKHRELRGLTSAGKKFRGLRGKGTTHHKNRPSRRATWKRNQTLSLRRY

SEQ ID NO: 49577 - DNA, 672 bp, Panicum virgatum
  misc_feature: Ceres CLONE 2050819
  misc_feature: Encodes the peptide sequence at SEQ ID NO. 49578
acacagctagcggcggcctgtcaactgtcatacccatccctctcgccccgggatctctctcctcttgggtcttggccagccatggcggagcggctggaggcggcgccggccgccggcgacgagtacacgcaggacggcacggtggacctccacggcaaccccgtgctccgctccaagcggggagggtggaaagcctgcggcttcgttgtagtgtacgaggtgttcgagcggatggcgttctacggcatctcgtcgaacctggtgctgtacctgacgacgaagctgcaccagggcgtggtgccgtcggcgaacaacgtcaccaactgggtgggcaccatctggatgacgcccatcatcggcgcctacgtcgccgacgcgcacctcggccgctaccgcaccttcatggccgcctccgtcatctacctctgcggcatgatcctgctgacgctggcggtgtcgctgccggcgctgcggccgcccaagtgcggcgacggcacggcggacccgaactgcacgcacgaggcgacgagcgcgcagctgggcgtcttcttcctgggcctgtacatcctggccgtgggcacgggcggcaccaagcccaacatctccaccatcggcgccgaccagttcgacgacaaccaccccgcgggaaccccgccccaagctctccttctt

SEQ ID NO: 49578 - protein, 196 aa, Panicum virgatum
  misc_feature: Ceres CLONE 2050819
  misc_feature: Functional homolog of the protein sequence given in SEQ ID NO 50283
  misc_feature: Useful for making plants with altered carbon content
  misc_feature: Useful for making plants with altered nitrogen content
MAERLEAAPAAGDEYTQDGTVDLHGNPVLRSKRGGWKACGFVVVYEVFERMAFYGISSNLVLYLTTKLHQGVVPSANNVTNWVGTIWMTPIIGAYVADAHLGRYRTFMAASVIYLCGMILLTLAVSLPALRPPKCGDGTADPNCTHEATSAQLGVFFLGLYILAVGTGGTKPNISTIGADQFDDNHPAGTPPQALL

SEQ ID NO: 49579 - DNA, 660 bp, Panicum virgatum
  misc_feature: Ceres CLONE 2050828
  misc_feature: Encodes the peptide sequence at SEQ ID NO. 49580
ctcacagagcaccagaccatctcagctagctatctttagactccggttgctgcgagaagcaaggcaagcatggaggggaaggaggaggacgtccgcctgggcgccaacaagttctccgagcgccagcccatcggcacggcggcgcaaggcaccgatgacaaggactacaaggagcccccgccggcgccgctcttcgagcccggggagctcaagtcctggtccttctaccgtgccggcatcgccgagttcgtcgccaccttcctcttcctctacatcagcatcctcaccgtgatgggcgtcagcaagtcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatggtcatgcagtgcctgggcgccatctgcggcgccggcgtcgtcaagggcttccagcaggggctgtacatgggcaacggcggcggcgccaacgtcgtcgcgcccggctacaccaagggcgacggcctcggcgctgagatcgtcggcaccttcatcctcgtctacaccgtcttctccgcc

SEQ ID NO: 49580 - protein, 196 aa, Panicum virgatum
  misc_feature: Ceres CLONE 2050828
  misc_feature (46)..(196): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50910
  misc_feature: Useful for making plants with modulated drought sensitivity
  misc_feature: Functional homolog of the protein sequence given in SEQ ID NO 50197
  misc_feature: Useful for making plants with modulated cold sensitivity
MEGKEEDVRLGANKFSERQPIGTAAQGTDDKDYKEPPPAPLFEPGELKSWSFYRAGIAEFVATFLFLYISILTVMGVSKSQSKCATVGIQGIAWSFGGMIFALVYCTAGISGGHINPAVTFGLFLARKLSLTRAIFYMVMQCLGAICGAGVVKGFQQGLYMGNGGGANVVAPGYTKGDGLGAEIVGTFILVYTVFS

SEQ ID NO: 49581 - DNA, 654 bp, Panicum virgatum
  misc_feature: Ceres CLONE 2050896
  misc_feature: Encodes the peptide sequence at SEQ ID NO. 49582
gcttggaagggaacttcgggcacatattaggcatgcagagagacgcatggttaaggctattcaaagggatttgaatagtgaccgcgagttacaagatcttgcacattatattgatgcatcgattgtcactaatggtctaaatcgtgcctttgccactggttcttggtgtcatccctacaaaagaactgaacggtgctcaggaattgttgcgactctaaggagaacaaatcctcttcaaatgatgtctgacttgagaaaaacccgtcagcgggttgcttatgctgggaaagctggtgatgctagatatccgaatccatcctactggggaatgctgtgttttatgtccactcctgatggtgaaaactgtggacttgtgaaaaatctagctgttactgctattgttagctctagagtggtgcagcctttgattgagagtttcatttcttgtggaatgagtaagctgaatgaaattcctactgagaacattcaaagaatggataagatttttctgaatggcaattgggtaggatcttgtactgattcagcttcatttgtattgcgattaaggtgcatgagacgcagcagtctgatcgatccacaggttgaaatcaaaagggacaagcaccaaaaggaagttcgtgtgttttctgatgc

SEQ ID NO: 49582 - protein, 217 aa, Panicum virgatum
  misc_feature: Ceres CLONE 2050896
  misc_feature (70)..(135): Pfam Name: RNA_pol_Rpb2_3 Pfam Description: RNA polymerase Rpb2, domain 3
  misc_feature (168)..(217): Pfam Name: RNA_pol_Rpb2_4 Pfam Description: RNA polymerase Rpb2, domain 4
  misc_feature: SWISSPROT Homolog: EC 2.7.7.6 DNA-directed RNA polymerase
LGRELRAHIRHAERRMVKAIQRDLNSDRELQDLAHYIDASIVTNGLNRAFATGSWCHPYKRTERCSGIVATLRRTNPLQMMSDLRKTRQRVAYAGKAGDARYPNPSYWGMLCFMSTPDGENCGLVKNLAVTAIVSSRVVQPLIESFISCGMSKLNEIPTENIQRMDKIFLNGNWVGSCTDSASFVLRLRCMRRSSLIDPQVEIKRDKHQKEVRVFSD

SEQ ID NO: 49583 - DNA, 674 bp, Panicum virgatum
  misc_feature: Ceres CLONE 2050900
  misc_feature: Encodes the peptide sequence at SEQ ID NO. 49584
gaggcatccttcgtcggatccgccatggctgccgctgcccccctcctctccctcctcctcttcctcctccttctcccggcctcaaattccatctactgcgacgaagacgactgctacgacctcctcgggcttaagcaggacgcgaacgcgtcggagatcaagaaagcctactacaaactctccctcaaacaccacccggacaagaaccccgatccggagtcgcggaagctcttcgtcaagatcgccaatgcttacgagattctgaaagatgaatccactagggagcagtatgactatgccattgcacatccggaggaggttttgtacaacacagctcagtactatagggcgtactatggacataaaacggatccgcgtgctgtgttgattggtcttcttctaatcgtctcagcatttcagtacataaatcagctgacaaggtataaccaggtatgggcatggaatgagaatgcaaatataaggttgtcaatgttttagctgtgaattcctattggttacaattgtccttttctattttcaggttttcaaccttatttctgctaaaccttttaccgtctcaatgttcccggcatttaaagtttaaaatcgcaaaaacattattttgatattggaaaacgtagtattgtgacttgaccaaattttggtgtaatttg

SEQ ID NO: 49584 - protein, 157 aa, Panicum virgatum
  misc_feature: Ceres CLONE 2050900
  misc_feature (29)..(90): Pfam Name: DnaJ Pfam Description: DnaJ domain
MAAAAPLLSLLLFLLLLPASNSIYCDEDDCYDLLGLKQDANASEIKKAYYKLSLKHHPDKNPDPESRKLFVKIANAYEILKDESTREQYDYAIAHPEEVLYNTAQYYRAYYGHKTDPRAVLIGLLLIVSAFQYINQLTRYNQVWAWNENANIRLSMF

SEQ ID NO: 49585 - DNA, 610 bp, Panicum virgatum
  misc_feature: Ceres CLONE 2050911
  misc_feature: Encodes the peptide sequence at SEQ ID NO. 49586
ttgaactacgtccaggttctcaacttattgatgacttgggtggccttcacaaatttatgaattggaaaagggcattgctgactgactctggtggtttccaaatggttgttccgagtcttttgttttctaaacacattaaatgtcattgtagagcgtatgggcatgcagaactaaacttttggtttcttcatttgattgatattttgctcatacaaaataatataaagtacaacacttgctgaagcccatttccacacaaaagcatcagtattcacctttcatacatactatgaacacctattttttaagtgttgggccccttccgtattgtagttcagctcctgttttgctaattttttttggaaattttcgtttaggtttcattgctgcatttggctgatattactgaggaaggagttacatttcaggtaaacttttgtagccacttgttatgtgatgctcttgttctttattaaagttactttaaatcatgttttgtagtcctctgttgcaatctgctttaaaactgatagtcaggtgtatcatgtactcatataattgaattgaatcttgtatgaggacatatttcagttttagtttaccactgtac

SEQ ID NO: 49586 - protein, 79 aa, Panicum virgatum
  misc_feature: Ceres CLONE 2050911
  misc_feature: SWISSPROT Homolog: EC 2.4.2.29 Queuine tRNA-ribosyltransferase
ELRPGSQLIDDLGGLHKFMNWKRALLTDSGGFQMVVPSLLFSKHIKCHCRAYGHAELNFWFLHLIDILLIQNNIKYNTC

SEQ ID NO: 49587 - DNA, 668 bp, Panicum virgatum
  misc_feature: Ceres CLONE 2050921
  misc_feature: Encodes the peptide sequence at SEQ ID NO. 49588
aggagagatggctgagtggactaaagcggcggattaaatccccctcttttttcccccacccacccaaaaccaagagatccaatcgaccaagaccaccaccatgggctccgccagccgcgccgtctcctgcctctgctgcccctgcaagtgcctcgcctgcggcctcttcagctgcctctgcagcatcctcatctccctcctcgtcaccctcggcgtcctcgccctcatcttctacctcatcttccgcccccacatgatcgccgccaccgtcgactccgcctccctcgccacattcaccctctccccgacctcctcgctcgcatacaacctcaccgtcgccatgaccgtgcgcaaccccaacaagcgcgtcggcctctactacgacaacgtcgaggccctcgccttctacaaggaccagcgcttcggctacgacccgctcgacgccttctaccagggcaccgaggcctccacccagctcaagcccgagttccacggacagcagctgctgcagggggacgtcaccgccgcgcagttcaggcaggaccagaccgacggcagcttcgccgtcaacgtcggcctcaacgccaagctcagggtcaaggtctgggccttcaaggtccgggggcccaaggccaggatcacctgcaagctcctcgtcccggcgccgg

SEQ ID NO: 49588 - protein, 189 aa, Panicum virgatum
  misc_feature: Ceres CLONE 2050921
  misc_feature (45)..(182): Pfam Name: Hin1 Pfam Description: Harpin-induced protein 1 (Hin1)
MGSASRAVSCLCCPCKCLACGLFSCLCSILISLLVTLGVLALIFYLIFRPHMIAATVDSASLATFTLSPTSSLAYNLTVAMTVRNPNKRVGLYYDNVEALAFYKDQRFGYDPLDAFYQGTEASTQLKPEFHGQQLLQGDVTAAQFRQDQTDGSFAVNVGLNAKLRVKVWAFKVRGPKARITCKLLVPAP

SEQ ID NO: 49589 - DNA, 591 bp, Panicum virgatum
  misc_feature: Ceres CLONE 2050922
  misc_feature: Encodes the peptide sequence at SEQ ID NO. 49590
cccacaaagcacaaagctttagcgcatacaagggcaaccaagcttaacacaatcctcaacacacacacctctcgaaagctccagcaggctcagcagcggcacaagccagccagcctcgtcgtcatggctcccaacctcagcaaggccacgccggacctgctcggcgacgcggccgcccccgtcgagggcctcaaggcgccgtcgcgcttcacgctcaagggcaaggacctcgccgtcgacggccacccgttcctgctcgacgtgccggccaacatccgcctcatcccggcgtcggcgctggtgcccgtcgccgcggcgggcggcagcttcctcggcttcgacgcgccggcggccaagagccgccacgtggtgcccgtcggcaggctccgcggcacccggttcatgagcatcttccgcttcaaggtgtggtggacgacccactgggtaggcgacagcggccgcgacgtggagaacgagacgcagctgatggtgctcgaccgctccggcgccggcgccggcgccggccgcccgtacgtgctgctgctccccatcgtcgagggcgccttccgcacctgcctcgagtccggcaag

SEQ ID NO: 49590 - protein, 155 aa, Panicum virgatum
  misc_feature: Ceres CLONE 2050922
  misc_feature: SWISSPROT Homolog: EC 2.4.1.67 Galactinol--raffinose galactosyltransferase
MAPNLSKATPDLLGDAAAPVEGLKAPSRFTLKGKDLAVDGHPFLLDVPANIRLIPASALVPVAAAGGSFLGFDAPAAKSRHVVPVGRLRGTRFMSIFRFKVWWTTHWVGDSGRDVENETQLMVLDRSGAGAGAGRPYVLLLPIVEGAFRTCLESG

SEQ ID NO: 49591 - DNA, 688 bp, Panicum virgatum
  misc_feature: Ceres CLONE 2050930
  misc_feature: Encodes the peptide sequence at SEQ ID NO. 49592
agatgcgcaaacaccgaatcgccggaccggtcgctgccctgctcgccctcaccctcaccctcaccctctcgctcacccgcagcgcgcaagaggagccgcccatggccgaccgcgggccgctggctggcggcgtcacggacgcgccgcagaacgacaacgacatccacctccaggagctcgcccgcttcgccgtcgacgaccacaacaagaagaccaatgctctcctggagttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgtggaagagagtgctagcgcttaaggatccctcgtcttccacgtgcaattgctgcctgaagcgctaaacagacttgcagaataaggagctggatcggatgtaatagctgtgtcgttgtgagctccgttgtgtaatatcgtatgaacaccttgccctttgtgtaatatcatgaatgacagtgccctttgtgtataactaaataactgcgctgagttttcatcagtacgagtcgtgacggaattctcatatcgcagtcttcaactaggagcacgttgattgttcaagtcttctgttagcttgtt

SEQ ID NO: 49592 - protein, 135 aa, Panicum virgatum
  misc_feature: Ceres CLONE 2050930
  misc_feature (42)..(130): Pfam Name: Cystatin Pfam Description: Cystatin domain
MRKHRIAGPVAALLALTLTLTLSLTRSAQEEPPMADRGPLAGGVTDAPQNDNDIHLQELARFAVDDHNKKTNALLEFEKLVKAKTQVVAGTMYYLTVEVKDGEAKKLYEAKVWEKPWENFKELQEFKPVEESASA

SEQ ID NO: 49593 - DNA, 513 bp, Panicum virgatum
  misc_feature: Ceres CLONE 2050957
  misc_feature: Encodes the peptide sequence at SEQ ID NO. 49594
tatatacaaggtccatttgattgatggccgtggtgctagctccagtcttgattctgcaagacagaatttggctgcaacatttgtcaatgcatttgtgaatgctgggtttggccaggacaagttgatgaccgctccatctgattcgtccagcagtgggtcttctggaaactggttgttcaagaacaaggaacacggaaaagccagtgcagcagctagtctgggaatgattcttctgtgggatactgattccgggcttgctcagcttgacaaatacttgcatagtaatgacactcatgttgttgctggagcgttgctaggtattggaattgtcacgtgcggtgtgaagaatgattgtgatcctgctcttgctattctcatggagtatattggaaaggatgactcgaacattcgtatcggtgcaatattgggtcttggtattgcatatgctggttcccagaaagaagagcttaaaatgcatctttctgctgtgttgggagactcccaatcaccact

SEQ ID NO: 49594 - protein, 170 aa, Panicum virgatum
  misc_feature: Ceres CLONE 2050957
  misc_feature (102)..(138): Pfam Name: PC_rep Pfam Description: Proteasome/cyclosome repeat
  misc_feature (68)..(101): Pfam Name: PC_rep Pfam Description: Proteasome/cyclosome repeat
IYKVHLIDGRGASSSLDSARQNLAATFVNAFVNAGFGQDKLMTAPSDSSSSGSSGNWLFKNKEHGKASAAASLGMILLWDTDSGLAQLDKYLHSNDTHVVAGALLGIGIVTCGVKNDCDPALAILMEYIGKDDSNIRIGAILGLGIAYAGSQKEELKMHLSAVLGDSQSP

SEQ ID NO: 49595 - DNA, 667 bp, Panicum virgatum
  misc_feature: Ceres CLONE 2050958
  misc_feature: Encodes the peptide sequence at SEQ ID NO. 49596
gaaaaaattcctgttggctccgtgagctttgggtgctcgcgtgcccgagcttcgcctccgatcgagcccgcccggcgaggcaggcgcccgatcgccgcgctacgggggtgcgccggatggagccgtacgcggctgcgaaggagggaggcgggggcggcgacgccagcaccggcttggaagagccgatgcggaggctggggctcggcggggacggggaggcgggggacgcgaagctgccggagcggccgggcgatgcggactgcgcctactacctccgcactggcgcctgcggctacggggagcgctgccgctacaaccacccccgcgaccgcgatcgggccaccccggttaatggagttggaaggaccgcaggtgcggttgagtaccctgagcgaccgggacagccactgtgtgagtactatgcaaagaatgggacctgtaaatttggttccaattgcaagtttgatcatcccagggaaggtggttttgcacctgtggcattaaacagcagtgggttccctcttcgtcagggtgaaaaggaatgttcctattacatgaaaactgggcattgcaagtttggaggtacatgtaaattccatcacccagaacttggtattctctcagaaacacctaccatctatccaccagtgcaaccatcacctgtttc

SEQ ID NO: 49596 - protein, 183 aa, Panicum virgatum
  misc_feature: Ceres CLONE 2050958
  misc_feature (94)..(120): Pfam Name: zf-CCCH Pfam Description: Zinc finger C-x8-C-x5-C-x3-H type (and similar)
  misc_feature (138)..(164): Pfam Name: zf-CCCH Pfam Description: Zinc finger C-x8-C-x5-C-x3-H type (and similar)
  misc_feature (44)..(70): Pfam Name: zf-CCCH Pfam Description: Zinc finger C-x8-C-x5-C-x3-H type (and similar)
  misc_feature: Functional homolog of the protein sequence given in SEQ ID NO 50340
  misc_feature: Useful for making plants with modulated nitrogen use efficiency
  misc_feature: Functional homolog of the protein sequence given in SEQ ID NO 50341
  misc_feature: Useful for making plants with modulated low light sensitivity
MEPYAAAKEGGGGGDASTGLEEPMRRLGLGGDGEAGDAKLPERPGDADCAYYLRTGACGYGERCRYNHPRDRDRATPVNGVGRTAGAVEYPERPGQPLCEYYAKNGTCKFGSNCKFDHPREGGFAPVALNSSGFPLRQGEKECSYYMKTGHCKFGGTCKFHHPELGILSETPTIYPPVQPSPV

SEQ ID NO: 49597 - DNA, 599 bp, Panicum virgatum
  misc_feature: Ceres CLONE 2050981
  misc_feature: Encodes the peptide sequence at SEQ ID NO. 49598
aacaggccccacttgatcaccttggtcaccccgacgggccccaccacctcccggccctctccgccgggcgccggccatcccctccccaaaatcctccctccatccaaccaatcccccaccgtgctcgccgcccaaatgccgccgcgggccgcctagggttccggctgccgccgcccccctcgccggtgcgatggggaatacctgcgtcggccccagcgcctcctcggaccgccacagcttcttcaactccgtctccctcgccgtgctctggcgccccgacgccgcccgccccgagccctccccggcctccgagcccaccccctccactcctcccccaacctcctccagagcccccgacccggtcaccatctccgaatccgagcactcgccccacaacccgaacggcaagcccaggcccaagcccaaggtgaagcgcgtgcagagcgccggcctcctcgtcgggtccgtcctaaggagggactccgagcggctcaaggacatctacaccctgggcaagaagctcgggcaggggcagttcggcaccacctaccagtgcgtcgagaaggcgacggggaagcagttcgcgtgcaagtccatcg

SEQ ID NO: 49598 - protein, 136 aa, Panicum virgatum
  misc_feature: Ceres CLONE 2050981
  misc_feature: SWISSPROT Homolog: EC 2.7.11.1 Non-specific serine/threonine protein kinase
MGNTCVGPSASSDRHSFFNSVSLAVLWRPDAARPEPSPASEPTPSTPPPTSSRAPDPVTISESEHSPHNPNGKPRPKPKVKRVQSAGLLVGSVLRRDSERLKDIYTLGKKLGQGQFGTTYQCVEKATGKQFACKSI

SEQ ID NO: 49599 - DNA, 691 bp, Panicum virgatum
  misc_feature: Ceres CLONE 2050988
  misc_feature: Encodes the peptide sequence at SEQ ID NO. 49600
actgttccctcccccttccgcatcccaaacggccaaaccctaacccccaaatccccaccctcctcccatggccgccgccgacgccgacgccgccgaggtggagcggctctacgagctcggcgagcgcctctcctccgccaaggacaagtccgagcacgccgcggactacgaggcgatcatcgcggcggtgaaggggcagagcgtcaaggcgaagcagctcgcggcacagctcatccccaggttcttccggagcttccccgcactcgccacgcgcgccatgtcggcaatgttcgacctcgtcgagatggaggagctcgcgatcagaatacaagctattcgggggtttccacttctaggcaaagatactgaatttgtgtcaaaaattgctgatattctaggacaactccttactagtgaggaaaatgtggagcgtgatgcggttcataaagccctcatgtcccttacacgacaagatgttaaaaattccttgcagtctttatttaagcatgtggagtcaggatcagagatccgtgagaagattatttgttttctaagagacaaggtctttcctcttaaagcagagctactaaaaccccaggcagaaatggagagatttataactgatttaataaagaaaagtgtacaagatgtaactggatcagaatttgaattattcatggggtttcctgcg

SEQ ID NO: 49600 - protein, 207 aa, Panicum virgatum
  misc_feature: Ceres CLONE 2050988
  misc_feature (10)..(207): Pfam Name: API5 Pfam Description: Apoptosis inhibitory protein 5 (API5)
MAAADADAAEVERLYELGERLSSAKDKSEHAADYEAIIAAVKGQSVKAKQLAAQLIPRFFRSFPALATRAMSAMFDLVEMEELAIRIQAIRGFPLLGKDTEFVSKIADILGQLLTSEENVERDAVHKALMSLTRQDVKNSLQSLFKHVESGSEIREKIICFLRDKVFPLKAELLKPQAEMERFITDLIKKSVQDVTGSEFELFMGFP

SEQ ID NO: 49601 - DNA, 677 bp, Panicum virgatum
  misc_feature: Ceres CLONE 2051021
  misc_feature: Encodes the peptide sequence at SEQ ID NO. 49602
aaaacacatttctttccttccttgctttcctaccttctcgctcgcttgcgtgtccccgtccattcctcagcactaaccctctctttccccccaacaatgccgccgtggaggcagcgtgcgcgaggcctccggcggtgctagatccgcagctaagcagagcgacgcgcgccgagccaaggcacctcgagcagcggcggcggcgaagaagaagaaggcgcaggaggaggcgtggccgccgcgacaggcgggggcgtccaatgcacgagcacacccgcgtcagggcctgggaggcgacggtgcgcaaggtgcagcttccccagcccgtgggccggcgccgggtgtccccgatgtcggccgcggaggactccgagacggcgtcctcctcggcgtcgtcctcgtcgggcggcggcgacgacggcgagcacgtgcacgggtacgtggagcgcggcctccccaacggcgacttctacacgggccagtggcgcggcggcgctcctcatggggcggggaagtacctgtggacggacgggtgcatgtacgagggggagtggcggcacggcaaggccactggccggagcaagttctcctggccgtcgggcgccacctacgagggcgagttcaaggacggcttcatggacggctccggcacctacaccggcgccgccggggacacctac

SEQ ID NO: 49602 - protein, 139 aa, Panicum virgatum
  misc_feature: Ceres CLONE 2051021
  misc_feature (117)..(139): Pfam Name: MORN Pfam Description: MORN repeat
  misc_feature (71)..(93): Pfam Name: MORN Pfam Description: MORN repeat
  misc_feature (94)..(116): Pfam Name: MORN Pfam Description: MORN repeat
  misc_feature: SWISSPROT Homolog: EC 2.7.1.68 1-phosphatidylinositol-4-phosphate 5-kinase
MHEHTRVRAWEATVRKVQLPQPVGRRRVSPMSAAEDSETASSSASSSSGGGDDGEHVHGYVERGLPNGDFYTGQWRGGAPHGAGKYLWTDGCMYEGEWRHGKATGRSKFSWPSGATYEGEFKDGFMDGSGTYTGAAGDT

SEQ ID NO: 49603 - DNA, 668 bp, Panicum virgatum
  misc_feature: Ceres CLONE 2051024
  misc_feature: Encodes the peptide sequence at SEQ ID NO. 49604
ctgtctccgccgccggccgccgccctcaccggctctcggagccctacccccctcttctcgccggagccccccacgccacatggaccggcagccccaggactacgcggcggcggccatggcgtacgcgcaggcgcagcagccacctcccccgcagtacggcggctaccatccgcaggcgccgccgccgcagtacccgccgccccacccttacggcgctccgctcccgcagtacccgcccgcgccctacgcgcgccccatgccgccggcctactcgcacctgccgccgcaccagcagccgcctcccccgtacgcggcgcacccgcctccgccgccacacatcttgtccacgccctccccgccgccgcaccatccctacatgcacccgccgccgttcgaacccgctccgccgccggccgcgccccccgctgatccggagctccagaagcgcatcgacaagctcgtcgagtacatcggcaagaacgggccggaattcgaggccgtgatccgcgacaagcagcacgacaacccggactacgccttcgtcttcggcggggaaggccacgcctactacaggtacttgctctggctcctgccgcgcccgccggtgccggcgccgtacccgccggggtcgatgcatatgatgccgccgatgggtgctcctatgatga

SEQ ID NO: 49604 - protein, 184 aa, Panicum virgatum
  misc_feature: Ceres CLONE 2051024
  misc_feature (112)..(155): Pfam Name: Surp Pfam Description: Surp module
MAYAQAQQPPPPQYGGYHPQAPPPQYPPPHPYGAPLPQYPPAPYARPMPPAYSHLPPHQQPPPPYAAHPPPPPHILSTPSPPPHHPYMHPPPFEPAPPPAAPPADPELQKRIDKLVEYIGKNGPEFEAVIRDKQHDNPDYAFVFGGEGHAYYRYLLWLLPRPPVPAPYPPGSMHMMPPMGAPMM

SEQ ID NO: 49605 - DNA, 529 bp, Panicum virgatum
  misc_feature: Ceres CLONE 2051025
  misc_feature: Encodes the peptide sequence at SEQ ID NO. 49606
aaccttcatcgtcttcctctgtccgccccctggtgccaccgcaggagggcagcatggctctcacccgcctcatcggcgccgcattgcctctgctcttcttcttcttcttctcacgtgcagaggcgggtgcgctgggcgtcagctacgggcgggtggcgaacgacctgccggacccggcgtcggtggtgaacctgctcaagcagaacggcatcaccatggtcaggatctacgacgccaaccccaatgttctgacgtccctggccaacactggcatcaaggtgatggtgatggtgcccaacgagaacgtggccgacgtggcctcggccccgtccaacgcgctccagtgggtgcgggacaacgtggcggcgtaccgccctgccacgcagatccacgccgtggccgtgggcaacgaggtgttcgactccaggcccgacctcaactcggccctcgtcccggccatgaccaacgtgcaggcggcgctggcgcagctgggcatggccgacgccgtgaaggtgaccacgccggtcgc

SEQ ID NO: 49606 - protein, 158 aa, Panicum virgatum
  misc_feature: Ceres CLONE 2051025
  misc_feature (27)..(158): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Functional homolog of the protein sequence given in SEQ ID NO 51629
  misc_feature: Useful for making plants with altered carbohydrate content
MALTRLIGAALPLLFFFFFSRAEAGALGVSYGRVANDLPDPASVVNLLKQNGITMVRIYDANPNVLTSLANTGIKVMVMVPNENVADVASAPSNALQWVRDNVAAYRPATQIHAVAVGNEVFDSRPDLNSALVPAMTNVQAALAQLGMADAVKVTTPV

SEQ ID NO: 49607 - DNA, 684 bp, Panicum virgatum
  misc_feature: Ceres CLONE 2051063
  misc_feature: Encodes the peptide sequence at SEQ ID NO. 49608
atacgcacccagcatgcagctgaacctagctagctagtactaagatatcattggaacgtattgataataatctcgaaggaagtatcaacgacaagctagcataagtccccaggaggcggcataccaactcatcatggtcgtcgttccactcctgatgctgatgctggtggtgtggtgccgcacttcttggcatcccgatcagcaagccgccgccgttgcggcaacgaggatggcaacgctcagcagctcccgccttcccctccggcgctgcccataatcggccacctgcacctcgtcggcgccctcccgcacgtctcactccgtgacctcgccgccaagcacgccgccggcggcctcatgctcctccgcctcggcaccgtccccaacctggtcgtgtcgtccccgcgtgcgtcgcaggcgatcatgcgcacgcacgaccacatcttcgcctcgcgcgcgacgaccggcatcagcgacactctcctgtatagctcgtctgatatcgccttggccccctacagcgagcactggcgccaggcaaggaagctcgtcactgcacacctcttcacagtcaagaaggtgcactcctaccgccatgcccgcaaagaagaggtgcgcctggtgatggccaaggtacgggaggcggcagctacgagcacagccgtggacatcggcgagatgatg

SEQ ID NO: 49608 - protein, 108 aa, Panicum virgatum
  misc_feature: Ceres CLONE 2051063
  misc_feature: SWISSPROT Homolog: EC 1.14.13.68 4-hydroxyphenylacetaldehyde oxime monooxygenase
MLLRLGTVPNLVVSSPRASQAIMRTHDHIFASRATTGISDTLLYSSSDIALAPYSEHWRQARKLVTAHLFTVKKVHSYRHARKEEVRLVMAKVREAAATSTAVDIGEM

SEQ ID NO: 49609 - DNA, 678 bp, Panicum virgatum
  misc_feature: Ceres CLONE 2051067
  misc_feature: Encodes the peptide sequence at SEQ ID NO. 49610
gtgaaaatagacttgaagctggagattcgtctttcgtgtcctctctgtccaactgcacccaactgacgaatttatggttggatagaaacaacctccaaggagtaatagaagactataccactaatatccccaaaagcttagaggtactggttctcattggtaaccagttgtcaggaactataccttcagcgataggaaacttcatgaacctcactcagcttcaattagataataacttactctcaggatttattccagacacacttggaaacctcagaaacttgtccatactaagcttatccaaaaataaactttcaggagaaattccacagtcaattggaaagctggagcagctcacaaatctttattttgaggaaaatgatttgaccgggctcatcccttctagtttacatggttgcaagcatttgacgaaactgaacctttcttccaataacttatatggacgcattccaccagaactcttttcaatatatacactttctgaaggcttagacttgtcctataatcaactcactgaagatataccatctgagattggtagattgattaatctgaattcacttcgtctttctaacaacaaattatctggagagattccttctacactcggtgagtgcgttcttttggattctcttcacttggagaaaaatttcctac

SEQ ID NO: 49610 - protein, 225 aa, Panicum virgatum
  misc_feature: Ceres CLONE 2051067
  misc_feature: SWISSPROT Homolog: EC 2.7.11.1 Non-specific serine/threonine protein kinase
ENRLEAGDSSFVSSLSNCTQLTNLWLDRNNLQGVIEDYTTNIPKSLEVLVLIGNQLSGTIPSAIGNFMNLTQLQLDNNLLSGFIPDTLGNLRNLSILSLSKNKLSGEIPQSIGKLEQLTNLYFEENDLTGLIPSSLHGCKHLTKLNLSSNNLYGRIPPELFSIYTLSEGLDLSYNQLTEDIPSEIGRLINLNSLRLSNNKLSGEIPSTLGECVLLDSLHLEKNFL

SEQ ID NO: 49611 - DNA, 653 bp, Panicum virgatum
  misc_feature: Ceres CLONE 2051071
  misc_feature: Encodes the peptide sequence at SEQ ID NO. 49612
aaagtcgaatttcttccattctcatttgagaatgcgaatacaaggaggtattttgtgtttgggaaagtccgaagaaaaaaggattttgaatccaccctttcttttgcttttttcccttagaaaaataactcaatcaaaatccaattatctactctacaagaacgaaatgcttggtatgcctaatatacttagtttaacctgtatctgttttaattctgttctttgtccgactagctttttcttcgccaaattacccgaagcttatgccattttcaacccaatcgtggatgttatgcctgtcatacctgtactcttttttctattagcgtttgtttggcaagccgctgtaagttttcgatgaaatctttactatctctgtctgccaatgtattcattcaaaaaaaaaaatggataagagccaagaagtcttatattatgaaccttcgattctaaaattgaaattcttctacattgaatgtatagctgcagcaataaatttggatccgcctttctatcccctgcggctacgttgagcaggtacctttaggtacccacacaatacctaaacaaatttttgatattgataagagtgctttttataaagcaattcttgcaattttttttaagaattgatttttgcatttttaggtgtc

SEQ ID NO: 49612 - protein, 119 aa, Panicum virgatum
  misc_feature: Ceres CLONE 2051071
  misc_feature (78)..(119): Pfam Name: PsbK Pfam Description: Photosystem II 4 kDa reaction centre component
KSNFFHSHLRMRIQGGILCLGKSEEKRILNPPFLLLFSLRKITQSKSNYLLYKNEMLGMPNILSLTCICFNSVLCPTSFFFAKLPEAYAIFNPIVDVMPVIPVLFFLLAFVWQAAVSFR

SEQ ID NO: 49613 - DNA, 659 bp, Panicum virgatum
  misc_feature: Ceres CLONE 2051077
  misc_feature: Encodes the peptide sequence at SEQ ID NO. 49614
acccacccctttccgtcctcctcctcctcccgtccactgccattgcccctccaagaaccgagacaacggaagagaccgatcgacccgggccgtcgtcctaggccggcccggcgcccaccccgcacccccgccatgcccggcggcgccgcgctcctcctcgccctgctgctggcggccgccgccgtcggcccgtccccggtcaatgccgcggtgtcgtacgaccaccgcgccgtggtcatcaacggccagcgccgcgtcctcatctcgggctccatccactacccgcggagcgcgccggagatgtggccggacctgctgcagaaggccaaggacggcggcctcgacgtggtccagacgtacgtgttctggaacgggcacgagcccgttcaggggcagttctacttcggcgaccgctacgacctcgtccgcttcgtcaagctcgcccaccaggccggcctctacgtccacctccgcatcggcccctacgtctgcgccgagtggaacttcggggggttcccggtgtggctcaagtacgtgccggggatcagcttccggacggacaacgggccgttcaaggcggcgatgcaggcgttcgtggagaaggtggtgtcgatgatgaaggcggaggggctgttcgattggcagggcgggcccgtcat

SEQ ID NO: 49614 - protein, 175 aa, Panicum virgatum
  misc_feature: Ceres CLONE 2051077
  misc_feature (33)..(175): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51152
  misc_feature: Useful for making plants with altered carbohydrate content
  misc_feature: Functional homolog of the protein sequence given in SEQ ID NO 51324
  misc_feature: Useful for making plants with altered cell wall content and/or composition
MPGGAALLLALLLAAAAVGPSPVNAAVSYDHRAVVINGQRRVLISGSIHYPRSAPEMWPDLLQKAKDGGLDVVQTYVFWNGHEPVQGQFYFGDRYDLVRFVKLAHQAGLYVHLRIGPYVCAEWNFGGFPVWLKYVPGISFRTDNGPFKAAMQAFVEKVVSMMKAEGLFDWQGGPV

SEQ ID NO: 49615 - DNA, 501 bp, Panicum virgatum
  misc_feature: Ceres CLONE 2051082
  misc_feature: Encodes the peptide sequence at SEQ ID NO. 49616
attagttttctgattttgatatttggaatgatcataattgatggtctcagctatgattattttatatatactgcgttttacaagccttaaagttatgtgcagccatatggttttgatgttggcaattctgatagaggcaatgttttaaaaggactggatcttggggttgagggtatgaaagttggtggccagaggttgatcattgttccacctgaactggcgtacggaaagaaaggtgtccaagaaattcctccaaatgcaaccattgagctggatgttgagctactatcaatcaagcagagtccatttgggactcctgtgaagatcatcgaaggataactgtgcatagcattgtaaagagaatggtacatatttgtgtggaaagtagagtgttgcttcgaaaaaaggctagtttacaaagatatactggtggtattgcattgatagtgcattcgtgtaagattttgaactccattggaatatagagttcgttttccgctt

SEQ ID NO: 49616 - protein, 54 aa, Panicum virgatum
  misc_feature: Ceres CLONE 2051082
  misc_feature: SWISSPROT Homolog: EC 5.2.1.8 Peptidylprolyl isomerase
MKVGGQRLIIVPPELAYGKKGVQEIPPNATIELDVELLSIKQSPFGTPVKIIEG

SEQ ID NO: 49617 - DNA, 711 bp, Panicum virgatum
  misc_feature: Ceres CLONE 2051103
  misc_feature: Encodes the peptide sequence at SEQ ID NO. 49618
gcatcactactccccgcagtccccactcgccactcccccccaaagctcctctccctctttctctctccgccatggcctctccctccaccgcctcctcctagccccgtccacgacacctcccagatcccgcccgcagtgcgccaccccccggcacaggcgcaacatgggagggtgccacgcgaagccgctcacccacgacgccgacacctcgccgccgcgcgccgcgccggcgaccccgcccccgggctgcgccaccccagccaccccggggaagaagcattgggcggtctcccccttcttctcgttctccaccccgagcccgagccccgcgcaccacctcttcggcggctccgcggcgtccccgcgcaagtcctcccccgcgcacccgggcgcggcggccggctccgcgcccaccaccccggccaggcgcctgctgcggctgcccttcccgccgccgtcgcccgccaagcacatcagggcggcgctcgccaggaggcacggcccgccgcggccctccatccccgaggaagtcggcggcgagggggagggctgcggtggcggcagggggctggacaaggggtttgggttcaacaagggcttcgcggccaagtacgatatgggggatgaagtcggaaggggacacttcggttacacctgcgccgccacggtttagaaaggcgcgcgcaaggggggatccgtcgccgtcaaggt

SEQ ID NO: 49618 - protein, 169 aa, Panicum virgatum
  misc_feature: Ceres CLONE 2051103
  misc_feature: SWISSPROT Homolog: EC 2.7.11.1 Non-specific serine/threonine protein kinase
MGGCHAKPLTHDADTSPPRAAPATPPPGCATPATPGKKHWAVSPFFSFSTPSPSPAHHLFGGSAASPRKSSPAHPGAAAGSAPTTPARRLLRLPFPPPSPAKHIRAALARRHGPPRPSIPEEVGGEGEGCGGGRGLDKGFGFNKGFAAKYDMGDEVGRGHFGYTCAATV

SEQ ID NO: 49619 - DNA, 686 bp, Panicum virgatum
  misc_feature: Ceres CLONE 2051129
  misc_feature: Encodes the peptide sequence at SEQ ID NO. 49620
acagatcggtgcatcacactccaactccaactagcagcagctccgagcatcttgcaccaccttgcgggccatggctgccgccgctgccgtatctgttccccgcatcaagctgggctcccaggggctggaggtctcggcgcagggcctcggctgcatgagcatgtccggcgtctacggcccgccgaagcctgagcccgacatgatcaaggtcatccaccacgccatcgccgccggggtcaccttccttgacacctccgacgtctacggcccacacaccaatgagatcctcctcggcaaggcgctgcaaggcggggtccgtgaaaaggtggagctgggaaccaagttcggcatcagcgtcggcgacgacggccggcccctgttctgtggggagccggcgtacgtccgggcagcgtgtgagggaagcctcaggagactcggtgtcgattgcattgacctctactaccagcaccgtgtcgataagaaggtgcccatcgaggtcacgattggtgaactcaagaagctagtcgatgaagggaaggtaaaatatatcgggctgtctgaaccatccgcatcaacaatcagaagagctcatgcagtccatcctatatctgcagttcagatagagtggtctctatggtccagagatgtagaagaagaagtgattcctacttgcagagaacttggaa

SEQ ID NO: 49620 - protein, 205 aa, Panicum virgatum
  misc_feature: Ceres CLONE 2051129
  misc_feature (15)..(205): Pfam Name: Aldo_ket_red Pfam Description: Aldo/keto reductase family
  misc_feature: SWISSPROT Homolog: EC 1.1.1.65 Pyridoxine 4-dehydrogenase
MAAAAAVSVPRIKLGSQGLEVSAQGLGCMSMSGVYGPPKPEPDMIKVIHHAIAAGVTFLDTSDVYGPHTNEILLGKALQGGVREKVELGTKFGISVGDDGRPLFCGEPAYVRAACEGSLRRLGVDCIDLYYQHRVDKKVPIEVTIGELKKLVDEGKVKYIGLSEPSASTIRRAHAVHPISAVQIEWSLWSRDVEEEVIPTCRELG

SEQ ID NO: 49621 - DNA, 634 bp, Panicum virgatum
  misc_feature: Ceres CLONE 2051143
  misc_feature: Encodes the peptide sequence at SEQ ID NO. 49622
aaatagttcactccagaggaagggagtgcgtttcatgaggctgataccctctttcgaggctgcgtcattagtgttctcactgaaaacatggtggattcttatgtcctactgccaactggcaaagaattgtgggatgctcttgaggctcaatatggagtgtctgatgccggcagtgagttgtatgcgatggagcagttccttgactataggatggtcgaagaccattctgtggtagaacaggctcatgaaatacatactctggcgaaagatctcaaaaattgtagcaaagagtctccatgtgtgttacccgataagtttgtggccggaggtattatctctaagctgccaccttcttagagggactttgctacttcactaaaacacaagagacaggagttcaccatagatggactcattgggactcttgatgttgaggagaaggcgagagcaaaggacatacgtgggaaaggagttgttggtgcgtcaagtgccaatcttgttcagaagaacaactcccacaagaataagaaaaagccaccgctgaaccaaccaaagactaagcagacaaccaccttcaagaagaagaagaagaagggagcttgctatgtgtgcgccagtatggaacactttgctg

SEQ ID NO: 49622 - protein, 89 aa, Panicum virgatum
  misc_feature: Ceres CLONE 2051143
  misc_feature: The sequence is a functional homolog of SEQ ID NO 1433 in the 10/374,780 US patent application
  misc_feature: The sequence is a functional homolog of SEQ ID NO 1519 in the 10/412,699 US patent application
MVDSYVLLPTGKELWDALEAQYGVSDAGSELYAMEQFLDYRMVEDHSVVEQAHEIHTLAKDLKNCSKESPCVLPDKFVAGGIISKLPPS

SEQ ID NO: 49623 - DNA, 727 bp, Panicum virgatum
  misc_feature: Ceres CLONE 2051144
  misc_feature: Encodes the peptide sequence at SEQ ID NO. 49624
ctgctaattcccttgcaatccgctcgctcccctgcttcgccaccgatcgatctagctcgtcccagaacaacggaagcgtacgtacagcaacgacgacctgctagccagagctagctagctgctttaattcttcctcagactgaaattttcctgaagattcctgtgctgcatgttgaattccacacgactaccataacaagtgaggatatgagttggtgttgtcttcctagaaccaagaaacaagagaatgcttactccaacagcataggcggtatttattctgagaagaacataaggatcttctcctatgctgagttaagatctgccacagataacttcaatcgcacaaacaaagtaggtcgaggtggctttgggacagtttataagggaaccattcgaaatgggcaagaggttgcggtgaaagttctttctgctgaatccaggcagggcattagagaattcttgacagaaattgatgtcattagcaacgtgaagcatcccaacctggttgaattaattggttgttgcgttgaaggaaataaccgaattttggtgtatgagtatcttaagaacagcagtcttgaccgtgcactgttgggttctaacagtgtgcctgctgactttacctggagcataagatctgctatatgtcttggagttgctcgaggtcttgcatacctgcacgaagagattgcatcaccgattgtacatagagatatcaaggcta

SEQ ID NO: 49624 - protein, 173 aa, Panicum virgatum
  misc_feature: Ceres CLONE 2051144
  misc_feature (44)..(171): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50776
  misc_feature: Useful for making plants with altered carbohydrate content
MSWCCLPRTKKQENAYSNSIGGIYSEKNIRIFSYAELRSATDNFNRTNKVGRGGFGTVYKGTIRNGQEVAVKVLSAESRQGIREFLTEIDVISNVKHPNLVELIGCCVEGNNRILVYEYLKNSSLDRALLGSNSVPADFTWSIRSAICLGVARGLAYLHEEIASPIVHRDIKA

SEQ ID NO: 49625 - DNA, 689 bp, Panicum virgatum
  misc_feature: Ceres CLONE 2051155
  misc_feature: Encodes the peptide sequence at SEQ ID NO. 49626
ataaccgaatcaaacgcgtccgccaggaggccagaaatatagcgaggaaggaagggggatagcggcgcagaaatggcgtcgatgcagagctggcgcaaggcctacggcgccatcaaggacacgaccaccgtcagcctcgccaacctcaactccgacttcaaggatctggatgtggcgatcgtgaaggcgactaaccacgtggagtgcccgcccaaggagcgccacctgcgcaaagttgttgcggcgacatccatcgccaggccacgagcggatgttgcctactgcatccacgctcttgcccgccgtcttgctaagacccgcaactggattgttgcactgaaaacacttgtagtgatccatagacttcttcgagagggtgatcctacatttcgagaagagcttcttaactttacacaaaggggacgaattctacaactttcaaactttaaggatgattccagcccaattgcttgggattgttctgcttgggttcgcacatacggtttgtttttggaggaaagattggaatgcttcagagttctgaagtatgatgtcgaagctgagcgtttgtccaaacagggtcaaggtcctgaaaagggacacagtagaactagagagttggattcacaggatctattagagcaattgccagcattgcagcagctattataccgacttgtgggatgccg

SEQ ID NO: 49626 - protein, 205 aa, Panicum virgatum
  misc_feature: Ceres CLONE 2051155
  misc_feature (29)..(204): Pfam Name: ANTH Pfam Description: ANTH domain
MASMQSWRKAYGAIKDTTTVSLANLNSDFKDLDVAIVKATNHVECPPKERHLRKVVAATSIARPRADVAYCIHALARRLAKTRNWIVALKTLVVIHRLLREGDPTFREELLNFTQRGRILQLSNFKDDSSPIAWDCSAWVRTYGLFLEERLECFRVLKYDVEAERLSKQGQGPEKGHSRTRELDSQDLLEQLPALQQLLYRLVGC

SEQ ID NO: 49627 - DNA, 661 bp, Panicum virgatum
  misc_feature: Ceres CLONE 2051156
  misc_feature: Encodes the peptide sequence at SEQ ID NO. 49628
tggcggcggcggcggctcccttctccttggtctccggcggcggcggggaggagctagcagctccgaggaggagatggcagcggcggggaatgagtggatcaacgggtacctggaggcgatcctggacgcgggcgcgaggcggcgcggggagcggggcgcgccggcgctaacgacgccgaggctgctgcaggcgccggcgctggcggaggcggcggcgtacagccctgcgcgctacttcgtcgaggaggtcgtcagccgcttcgacgaccgggacctccacaggacatggaccaaggtggtggcgatgcgcagcagccaggagcggaacaaccggctggagaacctgtgctggaggatctggcacgtcgccaggaagaagaagcaggtagagtgggagtactcgcagcagctagcacggcgacggctggagcaggagctgggcagccgcgaggctgccgaggagctctccgagggggagaaggaccgccccgacgacaccccgaccctccagccccctagcgcggccgacggcgaccagcagcagcagagccggttcgcgaggattaactccgagacccgaatcgtctccaacgacgaggacgaggcggccaaggaggaccggaacctctacatcgtcctcatcagcttacacgggctcgtc

SEQ ID NO: 49628 - protein, 195 aa, Panicum virgatum
  misc_feature: Ceres CLONE 2051156
  misc_feature: SWISSPROT Homolog: EC 2.4.1.14 Sucrose-phosphate synthase
MAAAGNEWINGYLEAILDAGARRRGERGAPALTTPRLLQAPALAEAAAYSPARYFVEEVVSRFDDRDLHRTWTKVVAMRSSQERNNRLENLCWRIWHVARKKKQVEWEYSQQLARRRLEQELGSREAAEELSEGEKDRPDDTPTLQPPSAADGDQQQQSRFARINSETRIVSNDEDEAAKEDRNLYIVLISLHGL

SEQ ID NO: 49629 - DNA, 669 bp, Panicum virgatum
  misc_feature: Ceres CLONE 2051183
  misc_feature: Encodes the peptide sequence at SEQ ID NO. 49630
ctgagggactaaaccccgcagccgccgcctctcgctctcctctcgcgccgccaccgccatacacctccgctccgatccgctccgctcctttccttctccgctctacctctcagatccagcgcggcgattctccgcttcctagcccggctctcccgggccccttgtgctagtttggttgcattcagggggctaggttttagattcggatacatggcagaagtggaggactacgagattattagggagggtgaggccgagatcctccagctcaagaaaaacgccgtcttcttcaatcccgtgcaggttcacaacagagacatgtccattgctgttttaagggcctttgttgccaagcgcaaggaagaacatgaagcgctggcgaataagaggaataaatcgcatcaagaaaacaaacatagtgaaacatctgttcagaatggagaggatgcttcaactagccagcctgatgaaatggatgttgttcctgaaaaggatcaaagtcaagctcaagcgacaaaaacaccttcctggaaagtaaccagagaacttaagccgccacttgttcttgaggctttggctgcttctgggttgagatctctccggtatgcccgtgaagttgatggcttaggaaaggtagttgctctggacaatgataaagcttctgtcgat

SEQ ID NO: 49630 - protein, 152 aa, Panicum virgatum
  misc_feature: Ceres CLONE 2051183
  misc_feature: SWISSPROT Homolog: EC 2.1.1.32 tRNA (guanine-N(2)-)-methyltransferase
MAEVEDYEIIREGEAEILQLKKNAVFFNPVQVHNRDMSIAVLRAFVAKRKEEHEALANKRNKSHQENKHSETSVQNGEDASTSQPDEMDVVPEKDQSQAQATKTPSWKVTRELKPPLVLEALAASGLRSLRYAREVDGLGKVVALDNDKASV

SEQ ID NO: 49631 - DNA, 682 bp, Panicum virgatum
  misc_feature: Ceres CLONE 2051196
  misc_feature: Encodes the peptide sequence at SEQ ID NO. 49632
aagtgccagcgccaccccgggacacgactcctcaccaagcatgccttccccttcgtcggcccactggctgagcctcgtcgggagcatctggctgcagaccatcaacggccccaactccgacttccccgtgtactcgtcgcagctcaaggacctgaagcacatctcgcaggtgcagctcaacttcctggcgttcgcgtccgacgcgggcaagctcttcggctggttctccggggtggcggccctgtacctgccgctctggctcgtggccttggtcggcgccgcgttcggcctcgtgggctacggcgtccagtacctgttcctcgacagcgcggggctccggtactggcacctcttcctgctcacctccctcgccgggaacggcatctgctggatcaacaccgtctgctacctcctctgcatccgcaacttcggctccggcagccgcgtcgcggtcagcctcgccaccagctacctcggcctcagcgccaaggtgtacaccagcctggccgactccattcccgggctggccggttcctccaaagccaaggcttacctcctcctcaatgccgtggtgccgatgctcgtcaccgtcgtggtggcgccgtcgctccgggtggtggacctcaagagcgcggcgagcacggacgccgcattcctcgtgatgttcgccatcacgcttcgc

SEQ ID NO: 49632 - protein, 213 aa, Panicum virgatum
  misc_feature: Ceres CLONE 2051196
  misc_feature (8)..(213): Pfam Name: Nodulin-like Pfam Description: Nodulin-like
MPSPSSAHWLSLVGSIWLQTINGPNSDFPVYSSQLKDLKHISQVQLNFLAFASDAGKLFGWFSGVAALYLPLWLVALVGAAFGLVGYGVQYLFLDSAGLRYWHLFLLTSLAGNGICWINTVCYLLCIRNFGSGSRVAVSLATSYLGLSAKVYTSLADSIPGLAGSSKAKAYLLLNAVVPMLVTVVVAPSLRVVDLKSAASTDAAFLVMFAITL

SEQ ID NO: 49633 - DNA, 693 bp, Panicum virgatum
  misc_feature: Ceres CLONE 2051199
  misc_feature: Encodes the peptide sequence at SEQ ID NO. 49634
attcgcacatccttccggcgcctacagaaaggccgctttgtcttctgaaggaggcggcgtatcgttgctgccgaccgccccggccgcttcagtttcagtctgaattagaattaccacaagcatggccgggaccgacaaccgcagagcattgatggaggattggatgcttccttcacccagcccaagaacactgatgtcaagcttcttgaacgaagaattcagctctggtccattctccagcatctttggtgacaatagcagtaacaaaccacaggatggaattgataagagcaaaacttttgcggatccgagcgttgaagaaactgtacaagatacaaaagcccctctgcagcttgaatccaacctttttagcacaaatcagaaatcaacctcacatggaggtcttgcagagaggatggctgccagggccggttttggagtcctgaaaattgacacatctcgtgtcagttcttctgcgccaattcggtctcctgtgacaataccaccaggtgtgagtccaagggagcttctggagtcaccagtttttctacccaatgccattgcacaaccttctcctacgaccggcaaattgccttttctgatgcctaataactttaaatcaatgatatcctcggtaccgaagaaggctgaagatcaatcgcaagatgattgtgcattttccttccagactat

SEQ ID NO: 49634 - protein, 190 aa, Panicum virgatum
  misc_feature: Ceres CLONE 2051199
  misc_feature: The sequence is a functional homolog of SEQ ID NO 1389 in the 10/412,699 US patent application
  misc_feature: The sequence is a functional homolog of SEQ ID NO 513 in the 10/374,780 US patent application
  misc_feature: The sequence is a functional homolog of SEQ ID NO 1390 in the 10/412,699 US patent application
  misc_feature: The sequence is a functional homolog of SEQ ID NO 514 in the 10/374,780 US patent application
MAGTDNRRALMEDWMLPSPSPRTLMSSFLNEEFSSGPFSSIFGDNSSNKPQDGIDKSKTFADPSVEETVQDTKAPLQLESNLFSTNQKSTSHGGLAERMAARAGFGVLKIDTSRVSSSAPIRSPVTIPPGVSPRELLESPVFLPNAIAQPSPTTGKLPFLMPNNFKSMISSVPKKAEDQSQDDCAFSFQT

SEQ ID NO: 49635 - DNA, 655 bp, Panicum virgatum
  misc_feature: Ceres CLONE 2051200
  misc_feature: Encodes the peptide sequence at SEQ ID NO. 49636
accacacaccgagacttgctcttcttcttgttgttgttgaggaatagatagatagaattctggggcagccggggctgagatcggcgaggagccgtccggccggccgtgcttgcttgcgccattgatacatccatccatctcatctactagagagggagttgtagcagcagatccacccaacacaatggagacccgggacagcgttccctccaccacgccgctcccctacgcctactcgccgctcccggccgccgacgccgcctccgccgaggtctccggcagcgccaacggccgccgcaggccgctctgcgccgccgcgctcgtgctgtccgccgcgctgctcctggccgtcgcggcgctggccggcgtccgcatcgcgcccccgcgccccatcacggtgggagtgggagagacgacgactgcggcggcggcggcgaggagcaggggccccgcggccggcgtgtcggagaagacgtccggcgcgtcgggggtgctgcttggcgagggcggcggcaacgccttcccctggagcaacgcgatgctgcaatggcagcgcacgggattccacttccagccgcagaagaactggatgaacgatcccaacggccctgtgtactacaaggggtggtaccacctcttctaccagtacaacccc

SEQ ID NO: 49636 - protein, 156 aa, Panicum virgatum
  misc_feature: Ceres CLONE 2051200
  misc_feature: SWISSPROT Homolog: EC 3.2.1.26 Beta-fructofuranosidase
  misc_feature: Functional homolog of the protein sequence given in SEQ ID NO 51130
  misc_feature: Useful for making plants with altered carbohydrate content
METRDSVPSTTPLPYAYSPLPAADAASAEVSGSANGRRRPLCAAALVLSAALLLAVAALAGVRIAPPRPITVGVGETTTAAAAARSRGPAAGVSEKTSGASGVLLGEGGGNAFPWSNAMLQWQRTGFHFQPQKNWMNDPNGPVYYKGWYHLFYQYN

SEQ ID NO: 49637 - DNA, 629 bp, Panicum virgatum
  misc_feature: Ceres CLONE 2051206
  misc_feature: Encodes the peptide sequence at SEQ ID NO. 49638
aactccaatccatctagcagcagctccgagcaacatcttgcacttgcaccaccttgccagccatggccgccgccgctcccgtatccgttccccgcatcaagctgggctcccaggggctggaggtctcggcgcagggcctcggctgcatgggcatgtccttcgcctacggctcgcccaagcccgagcccgacatgatcaagctcatccaccacgccattgccgccggggtcaccttcctcgacacctccgacatgtacggcccacacaccaacgagatcctcctcggcaaggcgctgcagggcggggtgagggacaaggtggagctggccacgaagttcggcgtcaatttcgtcggcgccggcaacttcgagatccgcggggacccggcgtacgtgcgcgcggcgtgcgagggcagcctcaagcgcctcggcgtggactgcgtcgacctctactaccagcaccgcatcgacaagaaggtgcccatcgaggtcacggtgagtctccatttgcttaacttctctttctttattggtacctgggaatctgggatggtggatgtaaacgcaaaaattgaatggaggctggaaatgtaaggggaaagttatacagatcacctgacagcgattgct

SEQ ID NO: 49638 - protein, 176 aa, Panicum virgatum
  misc_feature: Ceres CLONE 2051206
  misc_feature: SWISSPROT Homolog: EC 1.1.1.91 Aryl-alcohol dehydrogenase (NADP(+))
MAAAAPVSVPRIKLGSQGLEVSAQGLGCMGMSFAYGSPKPEPDMIKLIHHAIAAGVTFLDTSDMYGPHTNEILLGKALQGGVRDKVELATKFGVNFVGAGNFEIRGDPAYVRAACEGSLKRLGVDCVDLYYQHRIDKKVPIEVTVSLHLLNFSFFIGTWESGMVDVNAKIEWRLEM

SEQ ID NO: 49639 - DNA, 432 bp, Panicum virgatum
  misc_feature: Ceres CLONE 2051211
  misc_feature: Encodes the peptide sequence at SEQ ID NO. 49640
atgctgcttgactgggtgaaaggactgctcaaggagaagaaggtcgagatgttggtggacccagacctgcagaacgcctaccaggagaccgaggtggagagcctgatccaggtggcgctcctctgcacacagggttccccattggaccgacccaagatgtcagaggtggtgaggatgctggaaggcgacggcctggcggagcgatgggacgagtggcagaaggtggaggtggtgaggcaggaggctgagtcggcgccgctccgcaacgactggatcgtcgattcaacatataacctgcgggctgtggagctgtccggcccaaggtgacagccttacggggaaccagtcactccacgactccgaaagaagaattcgaaacttaattggcagattcagtctaattgctgcttgtgtatatgaaaggtagctttt

SEQ ID NO: 49640 - protein, 108 aa, Panicum virgatum
  misc_feature: Ceres CLONE 2051211
  misc_feature: SWISSPROT Homolog: EC 2.7.11.1 Non-specific serine/threonine protein kinase
MLLDWVKGLLKEKKVEMLVDPDLQNAYQETEVESLIQVALLCTQGSPLDRPKMSEVVRMLEGDGLAERWDEWQKVEVVRQEAESAPLRNDWIVDSTYNLRAVELSGPR

SEQ ID NO: 49641 - DNA, 680 bp, Panicum virgatum
  misc_feature: Ceres CLONE 2051213
  misc_feature: Encodes the peptide sequence at SEQ ID NO. 49642
actaactgcttctatgagcgcttgtctgctgtgtctgcagagaagaagtgcctcaactcggagctgtggcacgcgtgcgccggcccgctcgtctgcctccccaccgtcggcacgcgcgtcgtctacttcccgcagggccacagcgagcaggtggcagcgtcgacgaacaaggaggtggacgggcacatccccaactaccccaacctgccgccgcagctcatctgccagctacatgatgtcacaatgcatgcggatgtggagactgatgaagtgtacgctcagatgacgctgcagccgctgaacccacaagagcagaacgatgcatacctgccggcggagatggggatcatgagcaagcagcctacgaattacttctgcaagacgctgacggccagcgacaccagcacgcatggcgggttctctgtgccccgtcgtgcagcggagcgcgtcttcccccctctgtgtggtttgtaggatttcacacagcagcctccagcacaggagcttattgcacgggatattcatgatgtggagtggaagttcaggcatatcttccgaggccaacccaagagacacctgctgactactggctggagtgtgtttgtcagtgctaagagactcgttgctggagattctgtgctattcatatggaatgagaagaaccaactttttcttggaat

SEQ ID NO: 49642 - protein, 157 aa, Panicum virgatum
  misc_feature: Ceres CLONE 2051213
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 100 in the 10/666,642 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: The sequence is a functional homolog of SEQ ID NO 298 in the 10/412,699 US patent application
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
TNCFYERLSAVSAEKKCLNSELWHACAGPLVCLPTVGTRVVYFPQGHSEQVAASTNKEVDGHIPNYPNLPPQLICQLHDVTMHADVETDEVYAQMTLQPLNPQEQNDAYLPAEMGIMSKQPTNYFCKTLTASDTSTHGGFSVPRRAAERVFPPLCGL

SEQ ID NO: 49643 - DNA, 665 bp, Panicum virgatum
  misc_feature: Ceres CLONE 2051229
  misc_feature: Encodes the peptide sequence at SEQ ID NO. 49644
atagctggggagtagttcactgccccctacctctcctctcctctcctcccccctcctcctccccgtcgcgtcgcccatcctcctacgtctccctcctctcgccgcttccgcttcctcccagcgggagcggaagcgcgcaagcaatcgccggccttttcttggcgtgcacagctcctgatcggagggcccccgcgggatctcgcttgctggcctggccccgcgggattggggcggggcggctggattcggagccgctgcgggtggtgccggcatggcggcgccgggagggctcgagcagtggcagaaggacgggttcttccaggccgccgaggaggtgcaggagtcggcggacttgatggaatctatctatagaacttggatgcgagaacgcagtaatggttctagctcagaggaggcaaatgatttgcaaagggagctacagacagctttagggactgcaaaatggcagttggagcagtttgagagagctgtaagttcaagcaaggacaagtattcactggaagagggtacagtggctagacgtcggcagtttgttgtagcaatcgaggatcagatttctcgtgtggagaaagaaataaacagttcttcaatggacagtggcaggcaagggctcaactgggtgaagctagatgatgaggagcgag

SEQ ID NO: 49644 - protein, 131 aa, Panicum virgatum
  misc_feature: Ceres CLONE 2051229
  misc_feature (13)..(106): Pfam Name: Syntaxin-6_N Pfam Description: Syntaxin 6, N-terminal
MAAPGGLEQWQKDGFFQAAEEVQESADLMESIYRTWMRERSNGSSSEEANDLQRELQTALGTAKWQLEQFERAVSSSKDKYSLEEGTVARRRQFVVAIEDQISRVEKEINSSSMDSGRQGLNWVKLDDEER

SEQ ID NO: 49645 - DNA, 725 bp, Panicum virgatum
  misc_feature: Ceres CLONE 2051251
  misc_feature: Encodes the peptide sequence at SEQ ID NO. 49646
aacttctccctttctgcaccgaggcctgaatacgctccactccaaatctccaacactgaatccccccatatgcctgacgcttccttccatggcatccaagtaaacgtcgtcctacactcctacactggagggagaggattcgtggttcgtgcttggagcccgcaaatccatccgtgaccggtcaacaactccctggctttggtcgtttcttcagataaacatcagagagctgcaattcattcgttgaagtgggtgtggagaataaccttgtcgttacagattattaccggtttactaggttttcatcaggactgtttgacataaacagtgcactaccagaagtaccaattaggataaattaaagaaaagaaaccataaagaccaaggagttactccacaaacaacaccatggaatttattcaagaaagtgatagatctaagtggaaggcgcaaagtaatcatagcataaaatgcttcactaaaggtgacatagacagaatgactaacagctatcaaactagtcttggaagaggtgccttcggagaagtgtacgaaggggttcttgaggacggaagtatgattgcagtgaaaaggtttatccacaatgtgaaagaaaacttcgctaaagagctgatcgtccatcgtgaaatcaaccacaagaacgtagtgaggctcattggttgctgtgaggaggaaaatgcccttatgctggtcactgagtatgt

SEQ ID NO: 49646 - protein, 105 aa, Panicum virgatum
  misc_feature: Ceres CLONE 2051251
  misc_feature: SWISSPROT Homolog: EC 2.7.11.1 Non-specific serine/threonine protein kinase
MEFIQESDRSKWKAQSNHSIKCFTKGDIDRMTNSYQTSLGRGAFGEVYEGVLEDGSMIAVKRFIHNVKENFAKELIVHREINHKNVVRLIGCCEEENALMLVTEY

SEQ ID NO: 49647 - DNA, 666 bp, Panicum virgatum
  misc_feature: Ceres CLONE 2051279
  misc_feature: Encodes the peptide sequence at SEQ ID NO. 49648
aacgccgccgccacatccccacaacctgcacctcagctgtgcggtctgcggcggcggcgaaatggcggaaccggactggatcctggagagggagcggaggcagatggagcagatcctcgagctggacatggaggagctccaggtcgaggaggtcgacgacgacggctccaggtgctcgtgcggcgttgacaggttcctgagaggtactcatagagatggagggattagcacttctgaggagctaacagttgacacatctatggtttccttgcaagctaacacctatcttgaagcaaaggttgatggtacccgaggcaaatttactttcttggattgcgacagagtcctcaatttgccgatgctttatcttcaaggtgttgttttgtttcctgaagcttacctacctcttcgagtaattcagcctagattagcagaagctattgacaaggctgtcaatcatgttgatgctccatgcatgataggtgtggttcatgtttatcgaagtgcaaatgatggacatcatactattgcttctgtcggaacaacagcagagatacaggaaattcaacagttggatgatggttcatcatgtgttttctctcggggtcagcagcgatttcgtcttgcacgccattggttggacatcgatggagtaccatggggtga

SEQ ID NO: 49648 - protein, 201 aa, Panicum virgatum
  misc_feature: Ceres CLONE 2051279
  misc_feature: SWISSPROT Homolog: EC 3.4.21.53 Endopeptidase La
MAEPDWILERERRQMEQILELDMEELQVEEVDDDGSRCSCGVDRFLRGTHRDGGISTSEELTVDTSMVSLQANTYLEAKVDGTRGKFTFLDCDRVLNLPMLYLQGVVLFPEAYLPLRVIQPRLAEAIDKAVNHVDAPCMIGVVHVYRSANDGHHTIASVGTTAEIQEIQQLDDGSSCVFSRGQQRFRLARHWLDIDGVPWG

SEQ ID NO: 49649 - DNA, 690 bp, Panicum virgatum
  misc_feature: Ceres CLONE 2051282
  misc_feature: Encodes the peptide sequence at SEQ ID NO. 49650
agcgcacgcaccaccgccgcgcaacccccaacgcccccgccaccgccgccgctctcttcgccggagaagagagacaggaggaggggagcagcagcctcctccaggagcctagcctccgcgacccgatccccgacgagctcccccccctccgggcgtggccgagttgtaggcatcacggctagcgttgtagccccccggcgcggccccgcagctgcgcaggtggagcccacgggcaccatcgcctccgccgtcgccaccagccccgccccgcacggcggccgcggggcgctgccctcggccggagggagcccgtccgacctcctcttcctcgccggcggcggttgcctctgagccgctcccccacccttctctctctccatctgaccccttctcctcctcctaacaaccgtcgtctgctgaccccccgaccccgacaaacacgcacccgagagatttgagcgagccaccggccggccgccatggagatgaagctcaccatcaggagggtgcccaccgtcgtctccaactaccaggaggacgccgacaagccccgcgccggatgcgggaggaactgcctcggccaatgctgcctgcctgtttccaagcttcccctctatgctttcaaggcaaatccggcaaaacctgcacaggaggatgctgcttcaactaagtcccttgtcaatatcctcc

SEQ ID NO: 49650 - protein, 70 aa, Panicum virgatum
  misc_feature: Ceres CLONE 2051282
  misc_feature: Functional homolog of the protein sequence given in SEQ ID NO 50589
  misc_feature: Useful for making plants with modulated nitrogen use efficiency
MEMKLTIRRVPTVVSNYQEDADKPRAGCGRNCLGQCCLPVSKLPLYAFKANPAKPAQEDAASTKSLVNIL

SEQ ID NO: 49651 - DNA, 682 bp, Panicum virgatum
  misc_feature: Ceres CLONE 2051307
  misc_feature: Encodes the peptide sequence at SEQ ID NO. 49652
acagtacaattgaaggaaataatcaattaatatagctagctagaagaatcatggagtcagcaccagtgcaagtgatagagtcatgcatggtggcgccgccgacgccgacgaattcagggcggcggctgtggctctctcccctggacgtcgctctggccaacacaggccgtacttgtcaagtcttcttgtaccgttctggtgccgcctttttggacgtggccaggctcaaggaggcgatggccaaggcattggtggtctactacccgctggctggccgcctgattggcgatgatggcggcgtcagggtggtagagatcagctgcaatggcgagggcgctctctttgttgttgctcgctctcgtagcctcacagctcaagacgttgacttctccaagccatcgccggagttgaataccaagtttggtcctagcattgttgatccccagctcatcctggccacgcaggtgaatttcttaaagtgtggagcggtcgtgttagcagtgtccatgcaccacgccttagtggacggcgtgagcgcgtcgcacttcatgcaacattggtcggccttgtacaggggcgacgacggcggcgacgacgagctccgctgccacgaccacaccctcctccgtgcgcggtccccgcctgcggtccacccagacgcgctctcggtgctctactaccc

SEQ ID NO: 49652 - protein, 210 aa, Panicum virgatum
  misc_feature: Ceres CLONE 2051307
  misc_feature: SWISSPROT Homolog: EC 2.3.1.144 Anthranilate N-benzoyltransferase
MESAPVQVIESCMVAPPTPTNSGRRLWLSPLDVALANTGRTCQVFLYRSGAAFLDVARLKEAMAKALVVYYPLAGRLIGDDGGVRVVEISCNGEGALFVVARSRSLTAQDVDFSKPSPELNTKFGPSIVDPQLILATQVNFLKCGAVVLAVSMHHALVDGVSASHFMQHWSALYRGDDGGDDELRCHDHTLLRARSPPAVHPDALSVLYY

SEQ ID NO: 49653 - DNA, 632 bp, Panicum virgatum
  misc_feature: Ceres CLONE 2051327
  misc_feature: Encodes the peptide sequence at SEQ ID NO. 49654
agacgatccccctcctctcccagtcccagcgccggctagcctatccaacagtgaaaagcgcacgcgctccggccggagggagtgatcagtgatccgtcgtctgacgagagactggagtgggagaaagaggggcagcctagctgagctgcctcctccagctctgggctccccttgcttgtagctccgggcgtgcgggtctctgccgcgggagaaaaggcgagcactctgtgcgtgtccccgccaccagcctcctcatcgatctcctgctcgctcgatcccagccgtccgcgtacgacggcggcgatgccgtgctcgtcgccggccgcgacgtggctgctgcgcgtggggccagcggccgaccagcaggcctcgtccggcgccgccaccatggacacgggcggcgccgccgccgcggccgggcgtggcggcggcggcaatgcgcacgcgtccgacccccaggagagcagcagcagcgggggccagtcctcctcccgcctcgcggcgcgcggccactggcgccccgccgaggacgccaagctccgcgagctcgtcgcgctctacgggccccagaactggaacctcatcgccgagcggctcgacggccggtccggcaagagctgccgcctccggtg

SEQ ID NO: 49654 - protein, 109 aa, Panicum virgatum
  misc_feature: Ceres CLONE 2051327
  misc_feature (68)..(109): Pfam Name: Myb_DNA-binding Pfam Description: Myb-like DNA-binding domain
MPCSSPAATWLLRVGPAADQQASSGAATMDTGGAAAAAGRGGGGNAHASDPQESSSSGGQSSSRLAARGHWRPAEDAKLRELVALYGPQNWNLIAERLDGRSGKSCRLR

SEQ ID NO: 49655 - DNA, 695 bp, Panicum virgatum
  misc_feature: Ceres CLONE 2051351
  misc_feature: Encodes the peptide sequence at SEQ ID NO. 49656
gctttgagcggcgagagcaggggaggaggtcgggatttggatggtcgcggcggcgcggcggtggagttggtgtgctttccggaggaggtcttcatgggcaggtcgttcagggactcgctcaaggtgctcgaggccgacatccagcacgccaactcgcttgcttctgaattccggagggaatatgatggcgccacccttcagatgagaatggcatattgccctgctgcccatgttttcctttttcttgtccagtggacagattgcagccttgctggtgcacttgggctgttgaggattctaatttataaggtttatgctgatgggacaaccaccatgtctactcatgaaagaaaagcaagcatcagggaattttatgctgtcatatttccttctttgatgcaactacatgaaggaatcaatgaagtagaggataagaaacagaaagcaatatgtatagagaggtataaaaaacgggatgaggatccgaaaatggtgacatcagagattgacgataatatagaggaggaatgtggcatatgtatggagataaacaccaaagttgttcttccaacttgtagccatgctatgtgcattaaatgctatcgtgactggaggtcaagatcccagtcctgtccgttctgccgcgacggcctcaagagggtaaactctgctgatctatggatatacacggataa

SEQ ID NO: 49656 - protein, 200 aa, Panicum virgatum
  misc_feature: Ceres CLONE 2051351
  misc_feature (146)..(183): Pfam Name: zf-C3HC4 Pfam Description: Zinc finger, C3HC4 type (RING finger)
  misc_feature: Functional homolog of the protein sequence given in SEQ ID NO 50356
  misc_feature: Useful for making plants with altered lignin content
MGRSFRDSLKVLEADIQHANSLASEFRREYDGATLQMRMAYCPAAHVFLFLVQWTDCSLAGALGLLRILIYKVYADGTTTMSTHERKASIREFYAVIFPSLMQLHEGINEVEDKKQKAICIERYKKRDEDPKMVTSEIDDNIEEECGICMEINTKVVLPTCSHAMCIKCYRDWRSRSQSCPFCRDGLKRVNSADLWIYTD

SEQ ID NO: 49657 - DNA, 485 bp, Panicum virgatum
  misc_feature: Ceres CLONE 2051355
  misc_feature: Encodes the peptide sequence at SEQ ID NO. 49658
cccccatctctttacctaccggacgaggcagccgaaccctagcctacccctcgacacgcccttcccgccacagcgtgttcatcggacgaaggatgagcacgccctggatcctccttatctacatcgggaacctcccgggcgacatcagggagaaggaggtggaagatctcgtctacgattatgatataattgttcacattgaatttaatgtcccacctatgcctcctggatctgcttttgttgacttggagaatcctgccgatgctgaaaatgcaattgctgggtgggatggatacaattttaatggacaccccctaaaaccctaacccgatgacggtggtagagactatgctgcctcatatgaatcttcaggtggctttggtggaggagcacgacatggtgtggcacaccatactcagactcctgttcttggatttaaaatggcttcttctgcctcctggatcgatttaaatgatcatatgcag

SEQ ID NO: 49658 - protein, 77 aa, Panicum virgatum
  misc_feature: Ceres CLONE 2051355
  misc_feature (9)..(77): Pfam Name: RRM_1 Pfam Description: RNA recognition motif. (a.k.a. RRM, RBD, or RNP domain)
  misc_feature: Functional homolog of the protein sequence given in SEQ ID NO 51213
  misc_feature: Useful for making plants with altered alkaloid content
  misc_feature: Useful for making plants with altered lignin content
MSTPWILLIYIGNLPGDIREKEVEDLVYDYDIIVHIEFNVPPMPPGSAFVDLENPADAENAIAGWDGYNFNGHPLKP

SEQ ID NO: 49659 - DNA, 713 bp, Panicum virgatum
  misc_feature: Ceres CLONE 2051394
  misc_feature: Encodes the peptide sequence at SEQ ID NO. 49660
aacaaaacaactttgtaggtattgtgccgattaccatcgccaacctatctaaagagctctcatggctttcccttgctagaaaccaaatagctggaactataccggcagggttagggatgtttcaaagacttacgaagttaaacctggaggataacctcttcacaggtcccttaccggtggatattggtcgtcttcctagtcttcaggatcttgacctgtcccataatagatttgaaggacagattccacaatcatttggcaatatcacaaaattgagcaagctttctctatccaataactttctgggcgataccattccaccaagccttggtaacctgagaactcttgtgtccatagatatttcctgtaacttcttgagcggtcgaatcccacaagagatactgagcattccttccctaaccatacttctcaacctctccacaaatgctctgagtggctccatcccagcacagattggacacttgaacaacctcgtgtcaatcgacctctcaatgaataagctgactggtgcaatcccagacgctgttggaagctgtgtccaattgcgattgctacacttccaaggaaatctgctacaaggaaaaattccaaacggtctgaaaacattgggggtgcttgaaaacttggatctctctagcaataacttaacaggccccataccagaattcctagagagcatcaaaactctaaat

SEQ ID NO: 49660 - protein, 236 aa, Panicum virgatum
  misc_feature: Ceres CLONE 2051394
  misc_feature: SWISSPROT Homolog: EC 2.7.11.1 Non-specific serine/threonine protein kinase
QNNFVGIVPITIANLSKELSWLSLARNQIAGTIPAGLGMFQRLTKLNLEDNLFTGPLPVDIGRLPSLQDLDLSHNRFEGQIPQSFGNITKLSKLSLSNNFLGDTIPPSLGNLRTLVSIDISCNFLSGRIPQEILSIPSLTILLNLSTNALSGSIPAQIGHLNNLVSIDLSMNKLTGAIPDAVGSCVQLRLLHFQGNLLQGKIPNGLKTLGVLENLDLSSNNLTGPIPEFLESIKTL

SEQ ID NO: 49661 - DNA, 204 bp, Panicum virgatum
  misc_feature: Ceres CLONE 2051409
  misc_feature: Encodes the peptide sequence at SEQ ID NO. 49662
gttgctaagagcattgaattcaaggatagagtaaagaatgttggtgcgagccttgtgaagcaggttgccaatgcaactaatgacactgctggagatggtatgccattctatgttctgaatttggattgttgtgtgtaactcatggcatttgtaaagttacttggctgcttacctacttccaagcaatgtgcagaagtattcctg

SEQ ID NO: 49662 - protein, 45 aa, Panicum virgatum
  misc_feature: Ceres CLONE 2051409
  misc_feature: Functional homolog of the protein sequence given in SEQ ID NO 50704
  misc_feature: Useful for making plants with modulated nitrogen use efficiency
VAKSIEFKDRVKNVGASLVKQVANATNDTAGDGMPFYVLNLDCCV

SEQ ID NO: 49663 - DNA, 687 bp, Panicum virgatum
  misc_feature: Ceres CLONE 2051410
  misc_feature: Encodes the peptide sequence at SEQ ID NO. 49664
tctccgtccctcaccgagtcaccgttcgccaccaccaccaccaccgctaccacaccacgccacagtcgcagcgcgcaggccaggaccgcgcgcgcgcacgagagccggcggcagccatgtccgccccgaagctgggccgcaacccgagcatccgcgaccgcgtcgaggacaccctccacgcgcaccgcaacgagctcgtcgccctcctctccaagtacgtgaacaaggggaagggcatcctgcagccgcaccacatcctcgacgcgctcgacgaggtccagggctccgggggcggcgcgctcgccgagggccccttcctcgacgtcctccgctccgcgcaggaggcgatcgtgctgccgccgttcgtggccatcgcggtgcgcccgcgcccgggggtgtgggagtacgtccgcctcaacgtgcacgagctcagcgtcgagcagctcaccgtcccggagtacctgcgcttcaaggaggagctcgtcgacggccagcacaatgatccctacatgcttgagcttgacttcgagccattcaatgcctcagtcccacgcccaaatcggtcatcctctattggaaatggcgtgcagtttctcaatcgacacctctcttcgatcatgttccgcaacagggattgcctggaacccctgctggatttcctccgtggccaccggcacaagggtcatg

SEQ ID NO: 49664 - protein, 190 aa, Panicum virgatum
  misc_feature: Ceres CLONE 2051410
  misc_feature: SWISSPROT Homolog: EC 2.4.1.13 Sucrose synthase
  misc_feature: The sequence is a functional homolog of SEQ ID NO 12 in US patent 7091398
  misc_feature: The sequence is a functional homolog of SEQ ID NO 2 in US patent 7091398
  misc_feature: Functional homolog of the protein sequence given in SEQ ID NO 51468
  misc_feature: Useful for making plants with altered cell wall content and/or composition
MSAPKLGRNPSIRDRVEDTLHAHRNELVALLSKYVNKGKGILQPHHILDALDEVQGSGGGALAEGPFLDVLRSAQEAIVLPPFVAIAVRPRPGVWEYVRLNVHELSVEQLTVPEYLRFKEELVDGQHNDPYMLELDFEPFNASVPRPNRSSSIGNGVQFLNRHLSSIMFRNRDCLEPLLDFLRGHRHKGH

SEQ ID NO: 49665 - DNA, 694 bp, Panicum virgatum
  misc_feature: Ceres CLONE 2051435
  misc_feature: Encodes the peptide sequence at SEQ ID NO. 49666
cataattcttaagttgagcatgaagatggttcattccaacagaggatccttcttgtgaacctagtctgaccggccttggtatttgggggttgttctgtactctctttactttgtgagttgtgaaaggttcttgaagttagagttttagtagtagaggaagagagaatttgctaacatggcgttggcaggaacctccaaagtagtgctgggatgtatcgcctttgggattttctgggtgatggctgtcttccccagcgtcccgttcatgcccgttgggcggacggctgggtccctccttggtgccatgctaatggtcctgttccgtgtcatatcaccggaggacgcatatgctgcaattgatctcccaataattggtttgctctttggcacaatggtcgtcagcatcttccttgagagggctgacatgtttaagtatcttggcaacctgctctcatggaagagcagaggtagcaaagacctgctcttccgagtttgcatcgtgtccgcctttgccagcgcacttttcaccaatgacactacatgtgttgtgctcactgaattcatcctcaaggttgctaggcagaacaacctaccaccacagcctttcctgctggcccttgccactagttcaaacatcggctctgctgcgacgccgatcggtaacccccagaaccttgtcatagctgtggagagt

SEQ ID NO: 49666 - protein, 172 aa, Panicum virgatum
  misc_feature: Ceres CLONE 2051435
  misc_feature (16)..(172): Pfam Name: CitMHS Pfam Description: Citrate transporter
MALAGTSKVVLGCIAFGIFWVMAVFPSVPFMPVGRTAGSLLGAMLMVLFRVISPEDAYAAIDLPIIGLLFGTMVVSIFLERADMFKYLGNLLSWKSRGSKDLLFRVCIVSAFASALFTNDTTCVVLTEFILKVARQNNLPPQPFLLALATSSNIGSAATPIGNPQNLVIAVE

SEQ ID NO: 49667 - DNA, 494 bp, Panicum virgatum
  misc_feature: Ceres CLONE 2051454
  misc_feature: Encodes the peptide sequence at SEQ ID NO. 49668
gatgctcctaaacctcgtcctcttagtaggccttgccattagcaccgcaccactcaccgccggaaacgatgaccatcgccggttcgtctactccggcttcgccaacgctagcctcaccctcgacggcacagcgtcgatcacacctagcggcctgctcgagctgaccaacggcacggccatgagcatgggccgcgccttcttcccggatccactgcgcctccgtgactcatcactcgacggcaccacgatgcagtccttctccgcctccttcgtgttcggcatcatctccgtctacgacatgagcagccatggcctcaccttgttcgtcgcgccgaccaagaatttctccgcgatgccggtacagtacctgggcctcttcaacggctccaacaacggcaacacgtccaaccacatcttcgctgtggagctcgacacctggcaaaacatcgagttcggggacatcaacaacaaccacatcggcatcgacatcaatg

SEQ ID NO: 49668 - protein, 164 aa, Panicum virgatum
  misc_feature: Ceres CLONE 2051454
  misc_feature (24)..(164): Pfam Name: Lectin_legB Pfam Description: Legume lectin domain
MLLNLVLLVGLAISTAPLTAGNDDHRRFVYSGFANASLTLDGTASITPSGLLELTNGTAMSMGRAFFPDPLRLRDSSLDGTTMQSFSASFVFGIISVYDMSSHGLTLFVAPTKNFSAMPVQYLGLFNGSNNGNTSNHIFAVELDTWQNIEFGDINNNHIGIDIN

SEQ ID NO: 49669 - DNA, 690 bp, Panicum virgatum
  misc_feature: Ceres CLONE 2051457
  misc_feature: Encodes the peptide sequence at SEQ ID NO. 49670
attatggagttcatcttctctctccctctctcttcctctgatgtgttgttaagcagcgaagctaaaaaggggtgctcgtctgctgcctggagaggctggtcaagtacgcttccgaattaaaagcgctctggcctgcctgctctctcctcctcggccggccgcgtcctctccgccctcgctcccctccccttccccgcatttcttgatttcttcttctaccgggaacaatgtctccggcgccgacctcgcatcagtcgcagatcaattcgaggaaggagaagcgcatgaggaaggtggacaccttcgcgccgcacaacgacggccaccaatggaggaagtacggggagaagaagatcaacaacaccaacttccccagatactactatagatgcacctacaaggacaacatgaactgcccggccacgaagcaggtgcagcagaaggaccacagcgacccgccattgtacgcggtcacctactacaacgagcactcgtgcaacagcgccttcctcccgctctccccctccgagttccagctgcagacctcgtcggggaaggccgtctccatctgcttcgactcctcgtccgggccggcggcgcaagaaccgccgtccgccgccgccgccgcggcccccaatgccagcggcggctcgccctcctccagcgccgcgccgcggcgaggcacgcgcc

SEQ ID NO: 49670 - protein, 154 aa, Panicum virgatum
  misc_feature: Ceres CLONE 2051457
  misc_feature (29)..(92): Pfam Name: WRKY Pfam Description: WRKY DNA -binding domain
MSPAPTSHQSQINSRKEKRMRKVDTFAPHNDGHQWRKYGEKKINNTNFPRYYYRCTYKDNMNCPATKQVQQKDHSDPPLYAVTYYNEHSCNSAFLPLSPSEFQLQTSSGKAVSICFDSSSGPAAQEPPSAAAAAAPNASGGSPSSSAAPRRGTR

SEQ ID NO: 49671 - DNA, 505 bp, Panicum virgatum
  misc_feature: Ceres CLONE 2051496
  misc_feature: Encodes the peptide sequence at SEQ ID NO. 49672
atccggaccggagtaatggatgctctgcgggcatggagggcctccaatctcctcggcttcacagcctcccgcggtgtcagagccgcgtccgcggctaggccactccacctccgcctgcgtggctgctcttcagctgccgccacgacgaaacaaaagcggcagcagccgccgccgccgccgccgcggctgcctcaggaccgtcgtcaccataatgcctccgtcagccacctccgaacgcgactccatccgcgccaaccgcatcaaagaagttgaggagctaaaaagaaagggttatgagccatatgcgtacaagtgggataggactcacacgactaagaagcttcgtgaagagtacacccatcttgaaaatggtgaaatcgttgaagaggtagcggtatccattgacggcaggatagttgccggaagggcatttggaaagcttgttttcatgactataagagatgatactgggactattcagctttactgcgagaaagacaacctg

SEQ ID NO: 49672 - protein, 97 aa, Panicum virgatum
  misc_feature: Ceres CLONE 2051496
  misc_feature: SWISSPROT Homolog: EC 6.1.1.6 Lysine--tRNA ligase
MPPSATSERDSIRANRIKEVEELKRKGYEPYAYKWDRTHTTKKLREEYTHLENGEIVEEVAVSIDGRIVAGRAFGKLVFMTIRDDTGTIQLYCEKDN

SEQ ID NO: 49673 - DNA, 438 bp, Panicum virgatum
  misc_feature: Ceres CLONE 2051508
  misc_feature: Encodes the peptide sequence at SEQ ID NO. 49674
ttgagctttctgcttacctctccctgcctgttctttcaatgaactactctcgagggacgtttatcttccccggcgctccgccggcacatcaacgcagcttctctcaggaggtatccatgctcattggtttctttggtgggctcaagtctggtggcattgcatatgtgattggtgacgcgttcaaccccaatgagaaatggcctgtctattatgccacggacgagcctgaccagcctatggtgacactggagatgtgcatgactgggctggatgttaacaaagctgcagtgttctacaagaactccactgatggcagttgctcatcagcaaaggagatgaccaagctttcaggaatttctgagatcatccctcatatggagatctgtgactttgagttcaacccatgcgggtactcgatgaatggtgtcttctgacctg

SEQ ID NO: 49674 - protein, 143 aa, Panicum virgatum
  misc_feature: Ceres CLONE 2051508
  misc_feature (1)..(143): Pfam Name: SAM_decarbox Pfam Description: Adenosylmethionine decarboxylase
  misc_feature: SWISSPROT Homolog: EC 4.1.1.50 Adenosylmethionine decarboxylase
ELSAYLSLPVLSMNYSRGTFIFPGAPPAHQRSFSQEVSMLIGFFGGLKSGGIAYVIGDAFNPNEKWPVYYATDEPDQPMVTLEMCMTGLDVNKAAVFYKNSTDGSCSSAKEMTKLSGISEIIPHMEICDFEFNPCGYSMNGVF

SEQ ID NO: 49675 - DNA, 703 bp, Panicum virgatum
  misc_feature: Ceres CLONE 2051539
  misc_feature: Encodes the peptide sequence at SEQ ID NO. 49676
cgagcgccactctctcagccgtctccgcacccggcgcacggctgacgacggccgccggcagatggctccgacggtacgtgcggcggtggaggagtcggagcaggcgaggaaggtggtcgggctggcggcgttcgacccgtccggccacctctccccgctcgccatctaccggaggaggaccggaactgatgatgtggcgatcaaggtcctgtactgtgggatctgccactctgacctgcacaccatcaagaacgagtggaaggacaccatctaccccagcgtccccgggcacgagatcgccggagtggtcaccgaggtgggcgcgagcgtgacgaggttcaaggccggcgaccgcgtcggcgtgggctgcatggtggactcgtgccggtcctgcgaccgctgcgccggcggcttcgagaacctctgccgcggcgtcgtgtggacctacaactccgtcgacccgcgggacggcgccgccacctacggcggctactcgagcgcggtggtcgtgcacgagcgcttcgtggtgcggttcccgggcggcttgccgctgctgtgcgcgggcgtcaccgtgtacagccccctgcggcgccacgggctgggcgcgccggggaagcgcgtcggcgtggcggggctgggggggctggggcacgtcgccgtcaagttcgccagggcgctcgggggcggaggtgacggtggtccg

SEQ ID NO: 49676 - protein, 213 aa, Panicum virgatum
  misc_feature: Ceres CLONE 2051539
  misc_feature (42)..(158): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature: The sequence is a functional homolog of SEQ ID NO 2 in US patent 7288696
  misc_feature: Functional homolog of the protein sequence given in SEQ ID NO 51774
  misc_feature: Useful for making plants with altered cell wall content and/or composition
  misc_feature: Functional homolog of the protein sequence given in SEQ ID NO 50552
  misc_feature: Useful for making plants with altered carbohydrate content
  misc_feature: Functional homolog of the protein sequence given in SEQ ID NO 50554
  misc_feature: Useful for making plants with altered lignin content
MAPTVRAAVEESEQARKVVGLAAFDPSGHLSPLAIYRRRTGTDDVAIKVLYCGICHSDLHTIKNEWKDTIYPSVPGHEIAGVVTEVGASVTRFKAGDRVGVGCMVDSCRSCDRCAGGFENLCRGVVWTYNSVDPRDGAATYGGYSSAVVVHERFVVRFPGGLPLLCAGVTVYSPLRRHGLGAPGKRVGVAGLGGLGHVAVKFARALGGGGDGG

SEQ ID NO: 49677 - DNA, 684 bp, Panicum virgatum
  misc_feature: Ceres CLONE 2051550
  misc_feature: Encodes the peptide sequence at SEQ ID NO. 49678
aaaacatcacagaaaacatgggactcaattcttcatcacgtggccctctggcctcggcactactgctttgcttttgcatgctgtttctgggagtacatggaggatctcgcaggctttatatcgtctacctaggagatgtgaaacatggacacccggatgatgtcatcgcttcgcaccatgatcttctcagcaatgttcttggaagcatggaggattctttggcttccatgattcacaactacaagcatggcttctcaggcttcgcagccatgcttactgaagaccaagctaagcagcttgcagacttcccggatgtcatcagtgtccaacccagcagaaggctcaaggtggcgaccactcgaagctgggacttcctcgacctgaactaccaaatgcccaatgacctgctcaacaaaggcagatatggagaggacgtaatcatcggagttgttgatacaggtatctggccggagtcgagaagcttcagcgatgaagggtacgggcccgtgccgtcccggtggagaggaaagtgccaagtcggtcagggctgggaccgcaacaactgtagccgcaagatcatcggcgcacggttctacaccggcgggaaggacgaggaggagctcaagaagtccgactacctctcacccagggacgcgcacagccacggcacgcacacggcctcca

SEQ ID NO: 49678 - protein, 222 aa, Panicum virgatum
  misc_feature: Ceres CLONE 2051550
  misc_feature (32)..(112): Pfam Name: Subtilisin_N Pfam Description: Subtilisin N-terminal Region
  misc_feature: SWISSPROT Homolog: EC 3.4.21.25 Cucumisin
MGLNSSSRGPLASALLLCFCMLFLGVHGGSRRLYIVYLGDVKHGHPDDVIASHHDLLSNVLGSMEDSLASMIHNYKHGFSGFAAMLTEDQAKQLADFPDVISVQPSRRLKVATTRSWDFLDLNYQMPNDLLNKGRYGEDVIIGVVDTGIWPESRSFSDEGYGPVPSRWRGKCQVGQGWDRNNCSRKIIGARFYTGGKDEEELKKSDYLSPRDAHSHGTHTAS

SEQ ID NO: 49679 - DNA, 652 bp, Panicum virgatum
  misc_feature: Ceres CLONE 2051569
  misc_feature: Encodes the peptide sequence at SEQ ID NO. 49680
gaacatgaagatttaattgaagagttgaacaagctcctacacaaagagaagcatctcattgtacttgacaatgtatcgtcaattgataattggaaaggcttaataaaactttttccagatgagcttactgcaagtcgaatcatagtcacaacaagagaaaagactgttgctgaacattgttccagagagaacatgtacaagcttgaagctatgaaagatgatgacgcacttgaactcttcatgaacaaggtaaatatgaaagcagaacattttgatgggcaaccacaattattcaatcaagctagaagcatcgtcctcaagtgcaggggggttccccttgcaatatccacaataggcagcttcttggccaccaggcctagaacagttcaagaatgggcaaattttaccgagaatttccattccgagctggacaggaattcaagtctcaaaatattgaaaacatctctgacgtcccactgcgaggaattaccctatcatctcaagttatgctttttgtatttgtctattttctgtgaagatcagaacatgatcaggaggaaatgtttgataaggcggtggattgcggagggttacctcggtgacacaaacgcagaagagaatggtgaggtttacttggctgattttataaaca

SEQ ID NO: 49680 - protein, 217 aa, Panicum virgatum
  misc_feature: Ceres CLONE 2051569
  misc_feature (1)..(204): Pfam Name: NB-ARC Pfam Description: NB-ARC domain
EHEDLIEELNKLLHKEKHLIVLDNVSSIDNWKGLIKLFPDELTASRIIVTTREKTVAEHCSRENMYKLEAMKDDDALELFMNKVNMKAEHFDGQPQLFNQARSIVLKCRGVPLAISTIGSFLATRPRTVQEWANFTENFHSELDRNSSLKILKTSLTSHCEELPYHLKLCFLYLSIFCEDQNMIRRKCLIRRWIAEGYLGDTNAEENGEVYLADFIN

SEQ ID NO: 49681 - DNA, 699 bp, Panicum virgatum
  misc_feature: Ceres CLONE 2051585
  misc_feature: Encodes the peptide sequence at SEQ ID NO. 49682
acctgtttgcatcgcattcccctcctctccccgcgtctcccactcctcgcttatctccccccacctcccctgctcgccctgttggcaaaacctcctcctagtcctcctcccccaacgcaaaagaggcgccgtttgctatcgcgcggagcggcggaagcttctcgacctctctccaccgctgcccccgccgtcggctggttccgcgccgcgccggtgggattcgagccccgagctgccgagcggcgatcctcggattccactgaattcaactactgaagaaagccaaggaaggtggcgttggtagtgggagcgatcagcttgtggaatctttcccaaatactgcccaggatcatggctgccctttgtgatttctgtgggaaacaaaggtccatgatctactgcagatcagatgcggcatccttgtgcttatcatgtgatcgcaatgttcattcagctaatgcgctgtcccgccgtcacacaaggacccttctttgtgatcgttgttgctcacagcctgcagctgtccgctgtattgaagagaacacatcactttgccaaaattgtgattggaatgggcatgatgcagcatcaggggctactgggcataaaaggcaggccataaactgttactcggggtgcccatcatcggcagagctttcgagaatctggtcatttgttatggatatccctactgtacct

SEQ ID NO: 49682 - protein, 115 aa, Panicum virgatum
  misc_feature: Ceres CLONE 2051585
  misc_feature (1)..(47): Pfam Name: zf-B_box Pfam Description: B-box zinc finger
  misc_feature: The sequence is a functional homolog of SEQ ID NO 224 in the 10/412,699 US patent application
  misc_feature: The sequence is a functional homolog of SEQ ID NO 56 in the 10/374,780 US patent application
  misc_feature: The sequence is a functional homolog of SEQ ID NO 96 in the 10/225,068 US patent application
MAALCDFCGKQRSMIYCRSDAASLCLSCDRNVHSANALSRRHTRTLLCDRCCSQPAAVRCIEENTSLCQNCDWNGHDAASGATGHKRQAINCYSGCPSSAELSRIWSFVMDIPTV

SEQ ID NO: 49683 - DNA, 737 bp, Panicum virgatum
  misc_feature: Ceres CLONE 2051608
  misc_feature: Encodes the peptide sequence at SEQ ID NO. 49684
aatccacaatctcaactgtagcagagcagagtcccatgaggaaacagagcagtagatgagatagatcgtgtcagaggcaaccgcttgcggtacgcgccataattgggagataaatgccagcaaccagctcccaactccaagcaagtcgtaactgcaagaaagcaacggcagcaagaaaccttggaaccaccggagcagagatcgcggcgtcgatggcggcaaaggggaggacggagctggaggtgggcgccgacggcgtcgccgtcatcaccatctgcaatccgccggtcaactcgctctccgtcgacgtcttatatagcttaaaggaaagctatgaagaagcccttcggagaaatgatgtcaaagccattgttgttacagggaaaggaggaaaattttctggaggatttgatattagttcattcggtggtgttcagggaggcaaaacgttgcaaccaaaggttggttatatagcaattgatatcctcacagataccctagaagctgcaacaaagccatcggtggcagcaatagatggtcttgctcttggtggtggattagaagttgccatggcatgccatgcacgtattgcaactccaatggctcagttaggtcttccagaacttcaacttggaattattccaggatttggaggaacacaacgactcccacgtcttgttggactgacaaaatctctagaaatgatgttgctatctaagccaatcaggggtggtgag

SEQ ID NO: 49684 - protein, 174 aa, Panicum virgatum
  misc_feature: Ceres CLONE 2051608
  misc_feature (17)..(173): Pfam Name: ECH Pfam Description: Enoyl-CoA hydratase/isomerase family
  misc_feature: SWISSPROT Homolog: EC 4.2.1.55 3-hydroxybutyryl-CoA dehydratase
MAAKGRTELEVGADGVAVITICNPPVNSLSVDVLYSLKESYEEALRRNDVKAIVVTGKGGKFSGGFDISSFGGVQGGKTLQPKVGYIAIDILTDTLEAATKPSVAAIDGLALGGGLEVAMACHARIATPMAQLGLPELQLGIIPGFGGTQRLPRLVGLTKSLEMMLLSKPIRGG

SEQ ID NO: 49685 - DNA, 707 bp, Panicum virgatum
  misc_feature: Ceres CLONE 2051610
  misc_feature: Encodes the peptide sequence at SEQ ID NO. 49686
gacgaacaagcggccgcgcagaaatggcgtcgatgcagagctggcgcaaggcctacggcgccatcaaggacaccaccaccgtcagcctcgccaacctcaactccgacttcaaggtgcccctcgatccggatctggatgtggcgatcgtgaaggcgactaaccacgtggagtgcccgcccaaggagcgccacctgcgcaaagttgttgcggcgacgtccatcgccaggccacgggctgatgttgcctactgcatccacgctcttgcccgccgtcttgccaagacccgcaactggattgttgcactgaaaacacttgtagtgatccatagactacttcgcgagggcgatcctacatttcgagaagagcttcttaactttacacaaaggggacggattctacaactttcaaactttaaggatgattccagcccgattgcttgggattgttctgcttgggttcgcacatatggtttgtttttggaggaaaggttggaatgcttcagagttctgaagtatgatgtcgaagctgagcgtttgtccaaacagggtcaaggtcctgaaaagggacacagtagaactagagagttggattcacaggatctattagagcaactgccagcgttgcagcagttattatacagacttgtgggatgccggcctgaaggagctgcaaataacaactacttggtgcaatatgctctagctttg

SEQ ID NO: 49686 - protein, 227 aa, Panicum virgatum
  misc_feature: Ceres CLONE 2051610
  misc_feature (34)..(227): Pfam Name: ANTH Pfam Description: ANTH domain
MASMQSWRKAYGAIKDTTTVSLANLNSDFKVPLDPDLDVAIVKATNHVECPPKERHLRKVVAATSIARPRADVAYCIHALARRLAKTRNWIVALKTLVVIHRLLREGDPTFREELLNFTQRGRILQLSNFKDDSSPIAWDCSAWVRTYGLFLEERLECFRVLKYDVEAERLSKQGQGPEKGHSRTRELDSQDLLEQLPALQQLLYRLVGCRPEGAANNNYLVQYALA

SEQ ID NO: 49687 - DNA, 673 bp, Panicum virgatum
  misc_feature: Ceres CLONE 2051624
  misc_feature: Encodes the peptide sequence at SEQ ID NO. 49688
aacccacggaaaccaacacgccgggcaggatacaaccatacagagagcaagtagtcggggggcagtgcaactcatccagcgcacgcacagcccgtcgctccattccaccgccgccgaactccggcggatcctcctccccccttgttcctcctcgccagcagcccagccagtcctctcccgcccttgaagatggtgtccgccgtgctgaggaccatcctggtgacgggcggcgccgggtacatcggcagccacaccgtgctgcagctgctccagcagggcttccgcgtcttcgtcgtcgacaacctcgacaacgcatccgaggtcgccctcccccgcgttgccgagctcgccggccacaacggcagcaacctcgtcttccacaaggttgaccttcgcgacaggcacgcgctcgaggacatcttctcgtcccacaggtttgaggctgtgattcactttgctgggctcaaagctgttggcgagagcgtccagaagcccctgctgtactatgacaacaacctcatcggcaccatcacccttctcgaggtgatggctgcacatggctgcaagaaggtacttgtttgatactaatactactacgccaagtaggctttccgtcttttttctctggccctgcatttttgggcactcctgtttgctttacaactaggttttg

SEQ ID NO: 49688 - protein, 130 aa, Panicum virgatum
  misc_feature: Ceres CLONE 2051624
  misc_feature: SWISSPROT Homolog: EC 5.1.3.2 UDP-glucose 4-epimerase
  misc_feature: Functional homolog of the protein sequence given in SEQ ID NO 51775
  misc_feature: Useful for making plants with altered carbohydrate content
  misc_feature: Functional homolog of the protein sequence given in SEQ ID NO 51776
  misc_feature: Useful for making plants with altered cell wall content and/or composition
MVSAVLRTILVTGGAGYIGSHTVLQLLQQGFRVFVVDNLDNASEVALPRVAELAGHNGSNLVFHKVDLRDRHALEDIFSSHRFEAVIHFAGLKAVGESVQKPLLYYDNNLIGTITLLEVMAAHGCKKVLV

SEQ ID NO: 49689 - DNA, 411 bp, Panicum virgatum
  misc_feature: Ceres CLONE 2051626
  misc_feature: Encodes the peptide sequence at SEQ ID NO. 49690
aaaaaacaaccttaaacgaacacaccgcttcttcctccaccatgctgccgcagaaagaacatctggttctttagctagtcagagcccggatcgagcgcctctgcatcagggagtttcatgacagaatcatgcagccactgaatttgccatgctgcagcagtagcaactcaaaactaccggtgcctttctttgggctcgtcttcgttctcctactctcctcgacctctctcgtcagctcctgcacggagcaagaacggagctccctcattgacttccgagatgggctctcgctggagggtaatggcggcctcaacatgtcatggatcaacaacacagactgctgccactgggaaggaatcatttgcagcactggtggggtggtcacggatgtcttgcttggctctcaaggcc

SEQ ID NO: 49690 - protein, 94 aa, Panicum virgatum
  misc_feature: Ceres CLONE 2051626
  misc_feature (39)..(80): Pfam Name: LRRNT_2 Pfam Description: Leucine rich repeat N-terminal domain
MQPLNLPCCSSSNSKLPVPFFGLVFVLLLSSTSLVSSCTEQERSSLIDFRDGLSLEGNGGLNMSWINNTDCCHWEGIICSTGGVVTDVLLGSQG

SEQ ID NO: 49691 - DNA, 673 bp, Panicum virgatum
  misc_feature: Ceres CLONE 2051628
  misc_feature: Encodes the peptide sequence at SEQ ID NO. 49692
tccacaattgaagaaaaaagcacagggcgtattgatcaaattattggacccgtgctggatatcacttttcccccgggcaagttgccttatatttataacgctttgatagtcaagagtcgagacactgccgataagcaaattaatgtgacttgcgaggtacaacaattattaggaaataatcgagttagagctgtagctatgagtgctacagacgggttgatgagaggaatggaagtgattgacacgggagctcctctcagtgttccagtcggtggaactactctcggacgaatttttaacgttctgggggagcctattgacaatttaggtcctgtagatactagtgcaacattccctattcatagatctgcgcctgcctttatcgagttagatacgaaattatctatctttgaaacaggtattaaggtggtcgatcttttagctccttatcgacgtggaggaaaaatcggactatttgggggggcaggagtaggtaaaacagtactcatcatggaattaatcaataacattgctaaagctcatggaggcgtatccgtatttggtggagtaggggaacggactcgtgaaagaaatgatctttatatggaaatgaaggaatctggagtaattaatgaaaaaaatattgaggaatcaaaagtagctctagtctatg

SEQ ID NO: 49692 - protein, 224 aa, Panicum virgatum
  misc_feature: Ceres CLONE 2051628
  misc_feature (11)..(83): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
STIEEKSTGRIDQIIGPVLDITFPPGKLPYIYNALIVKSRDTADKQINVTCEVQQLLGNNRVRAVAMSATDGLMRGMEVIDTGAPLSVPVGGTTLGRIFNVLGEPIDNLGPVDTSATFPIHRSAPAFIELDTKLSIFETGIKVVDLLAPYRRGGKIGLFGGAGVGKTVLIMELINNIAKAHGGVSVFGGVGERTRERNDLYMEMKESGVINEKNIEESKVALVY

SEQ ID NO: 49693 - DNA, 611 bp, Panicum virgatum
  misc_feature: Ceres CLONE 2051631
  misc_feature: Encodes the peptide sequence at SEQ ID NO. 49694
gaacgaggaccggcaccaaccagagagagaagaagcaagcccgggagaagaggagaggccagcgcgagatcatcagagggagagaagtttgcaggcaaaaaaactagctgtctcccctccggaatctagctaattactttccagtccttctcccccatgtaagtctcccctccccgccgcctgcacctaccggaagcgacgcctcctccagcggttctggtccattcccgggtcgtcgccgtcggctatctagatggtggccgctcaccggagcacggcctccaccgccgcgctcctgctgctcctgctcgcggctgcggcctccgtctcttcttccgccgagttgcacctcggccaggagcaggacagatcggcgctactccagctcaagaacgccttcccttccgtggagctgctccggcggtggtccccggactccggcggcgccgaccactgcacctggccgggggtcacctgcgacgagaggtcccgggtcgtcgctctggaggtgcccggcccttcacggcgcttcgaaaccggcggggagctcgatggcgagctgccggccgcggttgggctcctcaccgagctgaaacaggtctcttttccgt

SEQ ID NO: 49694 - protein, 119 aa, Panicum virgatum
  misc_feature: Ceres CLONE 2051631
  misc_feature (35)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
MVAAHRSTASTAALLLLLLAAAASVSSSAELHLGQEQDRSALLQLKNAFPSVELLRRWSPDSGGADHCTWPGVTCDERSRVVALEVPGPSRRFETGGELDGELPAAVGLLTELKQVSFP

SEQ ID NO: 49695 - DNA, 569 bp, Panicum virgatum
  misc_feature: Ceres CLONE 2051637
  misc_feature: Encodes the peptide sequence at SEQ ID NO. 49696
acccctagtactgctcctccttgcgctcttcgcgcagcaagacatagaagaatcccctactactcatgcatgagcaccgcctcctcgcgccgcatatgaatcagacatgaataagggccacagcagcagctcctcgaagctcatcaacgagaagcttgaggaacaccggatctccaccgccaagcactgcccccactgcggtgagaaaatcgacagcaagccggattgggtggggctgccggccggagtcaagttcgatccaactgaccaggagatgatcgagcacctcgaggcgaaagtgaaggatgagggctcgagatctcaccctctcatcgacgagttcatacccacaatagatggggaggacggtatatgttacacccaccccgagaaacttccaggtgagagagctatctaagctagacaagagctgaaatgttactgaaccgtatacttatacgacatattcctggcttttcgagctttgcttttcatggagtgatatattgtatgttgggattgtattgcaatgaattatgtgctgtggtttggatttgggatatggaaca

SEQ ID NO: 49696 - protein, 103 aa, Panicum virgatum
  misc_feature: Ceres CLONE 2051637
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 1711 in the 10/374,780 US patent application
  misc_feature: The sequence is a functional homolog of SEQ ID NO 1712 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 1713 in the 10/374,780 US patent application
  misc_feature: The sequence is a functional homolog of SEQ ID NO 210 in the 10/666,642 US patent application
  misc_feature: Functional homolog of the protein sequence given in SEQ ID NO 50710
  misc_feature: Useful for making plants with altered carbohydrate content
MNKGHSSSSSKLINEKLEEHRISTAKHCPHCGEKIDSKPDWVGLPAGVKFDPTDQEMIEHLEAKVKDEGSRSHPLIDEFIPTIDGEDGICYTHPEKLPGERAI

SEQ ID NO: 49697 - DNA, 719 bp, Panicum virgatum
  misc_feature: Ceres CLONE 2051645
  misc_feature: Encodes the peptide sequence at SEQ ID NO. 49698
gggatcccagcttgcttctaattgcttgaagtatctggactggacattactggatgcgttgacttggccaactttcttactagagtacctgtatgtgacgggttgcattaagaatctaggggggcggagttttggtagaagcatcctagccactgaatactataaacttcctgttgccatgaagctgagagtgctgcaaatactctgtgatcatgtcattgaatcagatgaactcaaaactgaactggaggaccgagaaggctacaacgaggagctggaatatgagatggattctggcgcccttttggaggctggttcaagagcagtttcgactagagcctcaaaggcctctgcctacaaaaggatgaatgatttacagaacctggaaagcgctccgaatgtaacaaacccagaagatgcagtagcaaacgcttctcaggatggcaacagtgatgattgccgaatatgtggaatggatgggactttagtatgctgcgatggctgcccatgggcatatcattcaagatgtattggtcaaaacaaagccttccttccccagggagagtggttttgtccagaatgtgtggttaacaagcttggatcaacttcgtcaagaattgagcttggtgcaagaggagctcaaacattcggcattgatatgtgtgggaggctattcttaggaacctgcgactatttgctggtgatcgaaacatcttcag

SEQ ID NO: 49698 - protein, 239 aa, Panicum virgatum
  misc_feature: Ceres CLONE 2051645
  misc_feature (152)..(197): Pfam Name: PHD Pfam Description: PHD-finger
  misc_feature: SWISSPROT Homolog: EC 2.1.1.43 Histone-lysine N-methyltransferase
GSQLASNCLKYLDWTLLDALTWPTFLLEYLYVTGCIKNLGGRSFGRSILATEYYKLPVAMKLRVLQILCDHVIESDELKTELEDREGYNEELEYEMDSGALLEAGSRAVSTRASKASAYKRMNDLQNLESAPNVTNPEDAVANASQDGNSDDCRICGMDGTLVCCDGCPWAYHSRCIGQNKAFLPQGEWFCPECVVNKLGSTSSRIELGARGAQTFGIDMCGRLFLGTCDYLLVIETSS

SEQ ID NO: 49699 - DNA, 658 bp, Panicum virgatum
  misc_feature: Ceres CLONE 2051649
  misc_feature: Encodes the peptide sequence at SEQ ID NO. 49700
aaattcgcaatcgaggattcacaaacgccgcccctgccgccgtcgccgccgcgtcgccggctgctccgttgccccagcggggttagcgcacgcagcgcggcagggttctcggctagggcggccgtcacggtgcccgtggccgaccatggcgtggtcaccgggaagcgcaccgtcgcagagaccttctctaggctcagggagcagggcaagactgcattcattccattcatcaccgcgggtgatcctgacttagcaaccacatcgaaagcattgaagatcctcgattcctgcggttcagatgtgattgaggttggcgtaccatactcggatccgctggctgatgggccggttattcaggcatctgcaacacgtgcacttaagaaaggcactaccctcgaatctgtcatagggatgctgaaaggggttgcacctgagttgtcttgtcctatagttctcttcacatactacaacccaattctgaagcgtggggtgcgaaacttcatggctactatcagacaagctggcgtaaatggacttgtagtacctgatcttcctttggaggagacagtgttgctgaggagcgaggccattatgcacagcatagagctggtgctgcttacaacgccaaccactccaacagagaggatgatggaaattg

SEQ ID NO: 49700 - protein, 219 aa, Panicum virgatum
  misc_feature: Ceres CLONE 2051649
  misc_feature (62)..(219): Pfam Name: Trp_syntA Pfam Description: Tryptophan synthase alpha chain
  misc_feature: SWISSPROT Homolog: EC 4.2.1.20 Tryptophan synthase
KFAIEDSQTPPLPPSPPRRRLLRCPSGVSARSAAGFSARAAVTVPVADHGVVTGKRTVAETFSRLREQGKTAFIPFITAGDPDLATTSKALKILDSCGSDVIEVGVPYSDPLADGPVIQASATRALKKGTTLESVIGMLKGVAPELSCPIVLFTYYNPILKRGVRNFMATIRQAGVNGLVVPDLPLEETVLLRSEAIMHSIELVLLTTPTTPTERMMEI

SEQ ID NO: 49701 - DNA, 617 bp, Panicum virgatum
  misc_feature: Ceres CLONE 2051670
  misc_feature: Encodes the peptide sequence at SEQ ID NO. 49702
agcaagcccagcaaacaaactccgaagcgactgacgatcagaggcgtctttcagagcgcagcagttcgccgacaaatccccactccgaccttcaatcccgatcatcattcaacgacaatgtcgctgatccgccgcagcaacgtgttcgaccccttctccctcgacctctgggaccccttccagggcttccccttcggctccggcagcggcagcctcttcccgcgcatctcctcagactccgacgccgcggcgttcgctggtgcgcgcatcgactggaaggagacccccgaggcccacgtgttcaaggcggacgtgccggggctgaagaaggaggaggtgaaggtggaggtcgaggacggcaacgtgctccagatcagcggcgagcggagtccggcaagaggctggcgcaggtggtcagcgaccccagcctcaccaagtcgggggtctactggagctggaacaaggactcggcgtccttcgagaaccagctctcgcaggaggccagcgacccggagaaggcaaggaagctctgggagatcagcgagaagctcgtcggcctggcctgagcagaggagcttttatttgcttcgttgtttcatgtgtaccattagcaacca

SEQ ID NO: 49702 - protein, 166 aa, Panicum virgatum
  misc_feature: Ceres CLONE 2051670
  misc_feature (52)..(131): Pfam Name: HSP20 Pfam Description: Hsp20/alpha crystallin family
MSLIRRSNVFDPFSLDLWDPFQGFPFGSGSGSLFPRISSDSDAAAFAGARIDWKETPEAHVFKADVPGLKKEEVKVEVEDGNVLQISGERSPARGWRRWSATPASPSRGSTGAGTRTRRPSRTSSRRRPATRRRQGSSGRSARSSSAWPEQRSFYLLRCFMCTISN

SEQ ID NO: 49703 - DNA, 654 bp, Panicum virgatum
  misc_feature: Ceres CLONE 2051677
  misc_feature: Encodes the peptide sequence at SEQ ID NO. 49704
aggtgcaagacgctcccggctccccaccacgacttctccacaagtccatctcgaactctctagacccctcctcctcggtcccccctcggcttcgtcgtcgccccctcgcgagccgcggaaatggcgttgccgaatcagcaggtcgtggattacccaagcttcaagctcgtcatcgtcggcgacggtggaactggtaaaaccacatttgtcaaaaggcatcttactggcgagtttgagaagaaatatgaacccaccattggtgttgaagttcaccctctagattttagcaccaactgtggcaaaatccgcttctattgctgggacaccgctgggcaagaaaagtttggtggtctcagagatggctactatatccatggtcagtgtgccatcatcatgtttgatgtcacttcaagactgacatacaagaatgtaccaacatggcacagggacttgtgcagggtttgtgagaacattcccatcgtcctctgtggtaacaaggttgatgtgaagaacaggcaggtcaaagccaagcaagttacattccacaggaagaagaacctgcagtactatgaaatttctgcaaagagcaattacaatttcgagaagcccttcctttaccttgcaaggaagctggcaggggaccagaaccttcac

SEQ ID NO: 49704 - protein, 177 aa, Panicum virgatum
  misc_feature: Ceres CLONE 2051677
  misc_feature (15)..(173): Pfam Name: Ras Pfam Description: Ras family
  misc_feature (15)..(128): Pfam Name: Miro Pfam Description: Miro-like protein
MALPNQQVVDYPSFKLVIVGDGGTGKTTFVKRHLTGEFEKKYEPTIGVEVHPLDFSTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNL

SEQ ID NO: 49705 - DNA, 279 bp, Panicum virgatum
  misc_feature: Ceres CLONE 2051680
  misc_feature: Encodes the peptide sequence at SEQ ID NO. 49706
aaggcttttgatgaaaagcatcagctcacatcgactgcaactgccaaggtcgcttcccttgacaaaacaatgggcctaagccagaaattcaacaccagtaccatagttgtgaatgagaaaatgaaggaaatggatgagaaataccaggttgcagagaagacaaagtcagcattagctgctgctgaacagaccgtctctactgccagttctgctatcatgagcaacaggtatgtccttacaggggcagcatgggtaactggtgcctacagcaaggttgca

SEQ ID NO: 49706 - protein, 92 aa, Panicum virgatum
  misc_feature: Ceres CLONE 2051680
  misc_feature: Functional homolog of the protein sequence given in SEQ ID NO 51548
  misc_feature: Useful for making plants with altered alkaloid content
  misc_feature: Functional homolog of the protein sequence given in SEQ ID NO 50683
  misc_feature: Useful for making plants with altered lignin content
KAFDEKHQLTSTATAKVASLDKTMGLSQKFNTSTIVVNEKMKEMDEKYQVAEKTKSALAAAEQTVSTASSAIMSNRYVLTGAAWVTGAYSKV

SEQ ID NO: 49707 - DNA, 681 bp, Panicum virgatum
  misc_feature: Ceres CLONE 2051691
  misc_feature: Encodes the peptide sequence at SEQ ID NO. 49708
tctgtagtacagttgggttaaggtattctacttttcagtcctttgccttttggagatctaaaaggataaaaattatatgaaacaattccaattaaataaaaattgcttaatctgtcaactgttgcaggttgacatgatagtagtgactgatggaagcaggattttgggccttggtgatctgggggtgcaaggtattggcattgctattggaaaattggatttatatgttgctgctgctggaataaatcctcaaagggttcttcctgttatgatcgatgtcggaacgaacaatgagaagctccttaaggatcctctttatctcgggctacaagagcaccgtcttgagggagacgaatatgtctcagttattgatgaattcatggaagctgtttttactcgctggccaaatgttattgtacagtttgaggacttccaaagtaaatgggcctttaggctgttgcagcgttacagaaagacttatcgcatgtttaatgatgatgttcagggaactgctggtgttgcaatagctggccttttaggagctgtacgggcacaaggaaggccaatgatagatttcccaaagcaaaggattgttgttgctggtgctggcaggtccgaaacactctcaatcctttttcacttagtaattagtataaaattagagtatacacatgctaagtg

SEQ ID NO: 49708 - protein, 201 aa, Panicum virgatum
  misc_feature: Ceres CLONE 2051691
  misc_feature (6)..(140): Pfam Name: malic Pfam Description: Malic enzyme, N-terminal domain
  misc_feature: SWISSPROT Homolog: EC 1.1.1.39 Malate dehydrogenase (decarboxylating)
MKQFQLNKNCLICQLLQVDMIVVTDGSRILGLGDLGVQGIGIAIGKLDLYVAAAGINPQRVLPVMIDVGTNNEKLLKDPLYLGLQEHRLEGDEYVSVIDEFMEAVFTRWPNVIVQFEDFQSKWAFRLLQRYRKTYRMFNDDVQGTAGVAIAGLLGAVRAQGRPMIDFPKQRIVVAGAGRSETLSILFHLVISIKLEYTHAK

SEQ ID NO: 49709 - DNA, 698 bp, Panicum virgatum
  misc_feature: Ceres CLONE 2051693
  misc_feature: Encodes the peptide sequence at SEQ ID NO. 49710
atcgcccacgttgagacacgagttcctccctcccacctgggctcccccgcctccacgccgctccgctacgcgcgagccactgacccgcctcgcctagtccgcctccgctgcctctcttctcctccggagctcgcctctgcacattagtggaagccgagctgacaacaatctatcaagagttgcttcaacatggatactggctgtttatcatctatgaacattactggagtgagccaagcaagatcttttgcggggcaatttcctacccggagatgctttgcaagtagtcaccttgcaagctttgctgtgaaatctcttgtcttgaggaataaaggaagaagctcacaccgtagacattctgctttgcagattgtctgcaaggattttccaagacctccgctagaaagcacaataaactatttggaagctggacagctctcttcattttttaggaacagcgaacgccccagtaaaccattacaggtcgtgattgctggtgcaggattagctggtctgtcaacagcaaaatatctggcagatgcaggccataaacccatattgcttgaggcaagagatgttttgggcggaaaggtctgatagatacttgcatgattgtttaccactctcggaactgctcgtgtttactgtttccaccatttgttccttttatgttttttttgtgtgtttatgcattgaac

SEQ ID NO: 49710 - protein, 135 aa, Panicum virgatum; identical to SEQ ID NO: 47821
  misc_feature: Ceres CLONE 2051693
  misc_feature: SWISSPROT Homolog: EC 1.4.3.2 L-amino-acid oxidase

SEQ ID NO: 49711 - DNA, 674 bp, Panicum virgatum
  misc_feature: Ceres CLONE 2051699
  misc_feature: Encodes the peptide sequence at SEQ ID NO. 49712
acacacacggcacaccgccacggccgctgccggccgcctactccgagagcctcacccatcccgtaggcggcggcggcggcagcaccgcaggagcagaggagaaaaaggccttccggctccggaaccccgcggacccgaccagccacgcggccctcccatccgcgagacgcgcttccctccgaattccaaaaaagcacacgcgcgcgcgccatggcggagcgcctcgccgcctccctcctccccgcggcctccccgtccccgtccgcccgccgcgccacggtcggggccgcggccgcggccgccgcgcccttcccttcctcgtgccccggccgcgcggggctgcgcctccgctcctcccgccgcccggcccgcttctccaaggcggccgccggccgcggcggcggcggcggcggcgcgctgcgggtggtccggtgcatggcggcgtcggacgcggcgcagctcaagagcgcgcgggaggacatcagggggctcctcaagaccacgtactgccacccgatcatggtccgtcttgggtggcatgattctggtacgtatgacaagaatattgaggagtggccccagcgcggcggagctgatggaagcttaagatttcaacctgagttgaatcatggagccaatgctggtctgattaatgctttgaagcttatccaacc

SEQ ID NO: 49712 - protein, 154 aa, Panicum virgatum
  misc_feature: Ceres CLONE 2051699
  misc_feature: SWISSPROT Homolog: EC 1.11.1.11 L-ascorbate peroxidase
MAERLAASLLPAASPSPSARRATVGAAAAAAAPFPSSCPGRAGLRLRSSRRPARFSKAAAGRGGGGGGALRVVRCMAASDAAQLKSAREDIRGLLKTTYCHPIMVRLGWHDSGTYDKNIEEWPQRGGADGSLRFQPELNHGANAGLINALKLIQ

SEQ ID NO: 49713 - DNA, 649 bp, Panicum virgatum
  misc_feature: Ceres CLONE 2051703
  misc_feature: Encodes the peptide sequence at SEQ ID NO. 49714
agcttcctcagagcgctcgcgcgaaaccagccgagaggtctcgaggagaacgaacgaagcagccagattcccaagccgatttgggacgccggccggccacctcgccgtagtttccacctccgaccacgcgccggtggtgtccatcaacctgttcgtggcgctgctctgcgcctgcatcgtcctcggccacctcctcgaggagaaccggtgggtcaacgagtccatcaccgcgctcatcatcgggctgtgcaccggcgtggtgatcctgctgacgaccaaggggaagagctcgcacatcctcgtcttcagcgaggacctcttcttcatctacctcctgcctcccatcatcttcaatgccggcttccaggtaaagaagaagcaattcttccggaatttcatgacaatcacattatttggtgctgttgggacaatgatatccttcttcacgatctcgctcggtgccatatcaatattcagtagaatgaacattgggacgctagatgtaggggatttcctcgcaattggagcgatcttttctgcaacagattctgtctgcacattgcaggtcctcaatcaggatgagacaccccttttgtacagtcttgtgtttggtgaaggagttgtgaacgatgccacatcagttgtgctc

SEQ ID NO: 49714 - protein, 215 aa, Panicum virgatum
  misc_feature: Ceres CLONE 2051703
  misc_feature: The sequence is a functional homolog of SEQ ID NO 2 in US patent 7250560
  misc_feature: Functional homolog of the protein sequence given in SEQ ID NO 51120
  misc_feature: Useful for making plants with modulated water use efficiency
  misc_feature: The sequence is a functional homolog of SEQ ID NO 2 in US patent 7041875
  misc_feature: Functional homolog of the protein sequence given in SEQ ID NO 51121
  misc_feature: Useful for making plants with modulated drought sensitivity
  misc_feature: The sequence is a functional homolog of SEQ ID NO 4 in US patent 7250560
  misc_feature: The sequence is a functional homolog of SEQ ID NO 4 in US patent 7256326
ASSERSRETSREVSRRTNEAARFPSRFGTPAGHLAVVSTSDHAPVVSINLFVALLCACIVLGHLLEENRWVNESITALIIGLCTGVVILLTTKGKSSHILVFSEDLFFIYLLPPIIFNAGFQVKKKQFFRNFMTITLFGAVGTMISFFTISLGAISIFSRMNIGTLDVGDFLAIGAIFSATDSVCTLQVLNQDETPLLYSLVFGEGVVNDATSVV

SEQ ID NO: 49715 - DNA, 746 bp, Panicum virgatum
  misc_feature: Ceres CLONE 2051715
  misc_feature: Encodes the peptide sequence at SEQ ID NO. 49716
cactccccaccgcactagcgcagcatgccgctcccccgcctctcctccccgacccctcgcctcctcctccgcgccctcgccctcgccccgccccgccgcccttcctccccaccattaccaatagggttcgcgtcgccacgcctcgcagtcagagccgcagccccagctccgctccgcgcggtgctgtccgccgaccagcgggacctcgggatggaggcgggggagcaggggaggccgctccgggtcggcatcgtctgcggcgggccctccgccgagaggggcgtctccctcaactcggcacgctccgtgctggatcacattcagggccaggatttggtcgtcagctgctactacatcgactctggtatgaacgccttcgccatatcgccggcgcagctatattccaacacaccttcagattttgatttcaaactagaaagtttagcccaaggatttcactccctatctgactttgcggagcatcttgccaccaatgttgacattgtcttcccagtgatccatgggaaatttggtgaagatggtggcattcaggagctcttggagaaagcaaaggttccatttgttgggacgccctctaaggaatgtcagcatgcttttgacaagaaggacaagttggctacgtcagagttggaggcatggttccaaaccatcaatttgagcaaagaaaatggcaaagtgattgtcaaacctgcgagggctgggtcaagcattggtgtgggtgttgg

SEQ ID NO: 49716 - protein, 178 aa, Panicum virgatum
  misc_feature: Ceres CLONE 2051715
  misc_feature (10)..(129): Pfam Name: Dala_Dala_lig_N Pfam Description: D-ala D-ala ligase N-terminus
  misc_feature: SWISSPROT Homolog: EC 6.3.2.4 D-alanine--D-alanine ligase
MEAGEQGRPLRVGIVCGGPSAERGVSLNSARSVLDHIQGQDLVVSCYYIDSGMNAFAISPAQLYSNTPSDFDFKLESLAQGFHSLSDFAEHLATNVDIVFPVIHGKFGEDGGIQELLEKAKVPFVGTPSKECQHAFDKKDKLATSELEAWFQTINLSKENGKVIVKPARAGSSIGVGV

SEQ ID NO: 49717 - DNA, 518 bp, Panicum virgatum
  misc_feature: Ceres CLONE 2051725
  misc_feature: Encodes the peptide sequence at SEQ ID NO. 49718
gggaagcctattgaactggagtccaatgtatctggttctggggatattgaggatggcattgaaactttatcataacaagccatgtttttagctgagatggaggatgggaatcatgtgcaaatatggcttctacaggaagaatgaggaaccctactctagctctgccacgaacaggatcatcactgccaaggaccatgcctttgtgcagatcaacatcgggcacttgtatgagaatgatctgtacgatggccgcttcaccacgtttgccccctctgggtttgtccgtgctcagggtgatgctgacagctcgttggacaggctgtggcaagaagaggaaggccgagatcaagcagtggatcttgctcgcttctagtttcacctgccttggcgatgttttgatttctgtgtcgtgggccgtttggatatcatgccgtgagttcagttggcaccgaagaagcatggatcaagcttgttacgatgatccaaggattttataaaaaaatgccagttctctgctg

SEQ ID NO: 49718 - protein, 89 aa, Panicum virgatum
  misc_feature: Ceres CLONE 2051725
  misc_feature (12)..(83): Pfam Name: Ribosomal_S21e Pfam Description: Ribosomal protein S21e
MGIMCKYGFYRKNEEPYSSSATNRIITAKDHAFVQINIGHLYENDLYDGRFTTFAPSGFVRAQGDADSSLDRLWQEEEGRDQAVDLARF

SEQ ID NO: 49719 - DNA, 676 bp, Panicum virgatum
  misc_feature: Ceres CLONE 2051753
  misc_feature: Encodes the peptide sequence at SEQ ID NO. 49720
catttctgaaatgatgatgcagagtaaaatatacatgggcataatcaacacttatattcttcctgttctctacaacagtggaatgtcgtatggaactttttttggcttctataccatggatggtgattcatttattctggttgtagcgttttcggtttcggggacccaagatcctgtggtctggtctgccaaccctgacaatcctgtaagccagttagccgtcttgagcttcaccagtgaaggggatttgctcctccaagatggtggcaggttcatctggtccacagccacgaagaacatgtcagtcgcaggcatgagtcttgatctttcaggaaatcttgtgctttttgatcggagtaattcctcagtctggcagtcttttgaccacccaacaaatactttggtcatggggcagtcactttgtaggggaatgaatcttactgccaagccatcgaaaacaaaatggtcatcttccaggttttgtctttctgcagagtggaatgggctgctccactctttcagtccagcagcttacacacagctattccaaaccacagctacaactacttctagccaaacaacatgctacacgtttgtcaatggaagccttgggttcccagataagatcttctcattaccgtcagcaagttcattgcagttcatgaggttagaatct

SEQ ID NO: 49720 - protein, 221 aa, Panicum virgatum
  misc_feature: Ceres CLONE 2051753
  misc_feature (53)..(158): Pfam Name: B_lectin Pfam Description: D-mannose binding lectin
MMMQSKIYMGIINTYILPVLYNSGMSYGTFFGFYTMDGDSFILVVAFSVSGTQDPVVWSANPDNPVSQLAVLSFTSEGDLLLQDGGRFIWSTATKNMSVAGMSLDLSGNLVLFDRSNSSVWQSFDHPTNTLVMGQSLCRGMNLTAKPSKTKWSSSRFCLSAEWNGLLHSFSPAAYTQLFQTTATTTSSQTTCYTFVNGSLGFPDKIFSLPSASSLQFMRLE

SEQ ID NO: 49721 - DNA, 652 bp, Panicum virgatum
  misc_feature: Ceres CLONE 2051762
  misc_feature: Encodes the peptide sequence at SEQ ID NO. 49722
ttctctctccctcgtcactctcgccactgctcccagctgttgcgacctccgatcatccaaggcttctgcacccctgtcagtcctagctccagccaaaaatcgttggcttccgctgcctgctcctccgccttgcacctcccatgaccttccacacgacatgattgcattgcaggcccctgcggagctcagtgtcctcccacgccgctgacgccttcttgttgcctccccgctgctgcgcacaaccgaaagggccttcctctcttccttcgcttccgcggaaagatttggcgatttgttcatctactaaagttgcatctctcttgtgcgtgtttgccaccgtggtcttgttatcatcgtccaacgttgggtcgtctgatagatatagatctgggccatctggtgatttgcttgttcctcttcagggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggtccttcaccagattgag

SEQ ID NO: 49722 - protein, 65 aa, Panicum virgatum
  misc_feature: Ceres CLONE 2051762
  misc_feature: Functional homolog of the protein sequence given in SEQ ID NO 51454
  misc_feature: Useful for making plants with modulated salt sensitivity
MGKKGKWFGAVKKVFSPESKEKKEERQRRKSAASNPTPRDLTPSTSLEVNVSVPPPPAPPVLHQI

SEQ ID NO: 49723 - DNA, 712 bp, Panicum virgatum
  misc_feature: Ceres CLONE 2051772
  misc_feature: Encodes the peptide sequence at SEQ ID NO. 49724
ataaagaaagccctggggctgataaaccttgcatctcctcattgagcttgttgtcatatagataagacatgggtcaagcacttggtttgattcaagtggatcaatcgacagtagccatcaaggaatcttttggaaagtttgatgagatcttagggcctgggtgccacttcttgccatggtgcatagggaagcaaattgctgggtacctttcactgcgtgttcagcagcttgatgtccgctgcgaaacaaagacaaaggataatgtcttcgtcaatgttgtggcatctgtgcaataccgtgcccttgcggacaaggcgtctgatgccttttacaggcttactaacaccagggagcagatccagtcatatgtctttgatgtcatcagggctagtgttcctaagatgaacttggatgatgcatttgagcagaagaatgatattgctaaagcggtggaagatgaacttgaaaaggcaatgtcaatgtatggatatgagattgtgcagactctgattgttgatattgagcctgatgagcatgtgaagagagccatgaatgagatcaatgcagctgctaggctgaggctggctgccaatgagaaagctgaagcagagaagatcctgcagatcaagagagctgaaggtgatgcagaatccaagtacttggccggtatgggtattgcaaggcagcgccaggctatagtggatgggctgag

SEQ ID NO: 49724 - protein, 214 aa, Panicum virgatum
  misc_feature: Ceres CLONE 2051772
  misc_feature (8)..(182): Pfam Name: Band_7 Pfam Description: SPFH domain / Band 7 family
MGQALGLIQVDQSTVAIKESFGKFDEILGPGCHFLPWCIGKQIAGYLSLRVQQLDVRCETKTKDNVFVNVVASVQYRALADKASDAFYRLTNTREQIQSYVFDVIRASVPKMNLDDAFEQKNDIAKAVEDELEKAMSMYGYEIVQTLIVDIEPDEHVKRAMNEINAAARLRLAANEKAEAEKILQIKRAEGDAESKYLAGMGIARQRQAIVDGL

SEQ ID NO: 49725 - DNA, 715 bp, Panicum virgatum
  misc_feature: Ceres CLONE 2051778
  misc_feature: Encodes the peptide sequence at SEQ ID NO. 49726
  misc_feature (640)..(640): n is a, c, t, g, unknown, or other
cctcttcatcgacgagatccacctcgtcctcggcgcgggcaggacggaggggtccatggacgccgccaacctgttcaagcccatgctcgcgaggggccagctccggtgcatcggcgccaccacgctggaggagtaccgcaagtacgtggagaaggacgccgcgttcgagcggcgcttccagcaggtgttcgtcgccgagccgagcgtggccgacaccgtcagcatcctgagggggctcaaggagaagtacgaggggcaccatggtgtgaggatccaggaccgcgccctcgtcgtcgccgcgcagctctccgcgaggtacatcatgggtcggcacctgcctgacaaagccatagacctggtggacgaggcctgcgccaatgtgagggtgcagctcgacagccagccggaggagattgataacctcgagaggaagaggattcagcttgaagtcgagctccacgcgctcgagaaggagaaggacaaggccagcaaagcccggctggttgaggtcagaaaggaattggacgatttgagggacaagctgcaacccctgacaatgaagtacaggaaggagaaggagaggatcgatgagatcaggaagctgaagcagcgccgcgaggagctgatgttcagcctgcangaggccgagcgccggatggacttggctcgtgtggccgacctcaagtacggcgccctccaggagctcgacgccgcc

SEQ ID NO: 49726 - protein, 237 aa, Panicum virgatum
  misc_feature: Ceres CLONE 2051778
  misc_feature: Functional homolog of the protein sequence given in SEQ ID NO 50876
  misc_feature: Useful for making plants with modulated heat sensitivity
  misc_feature (213)..(213): Xaa is any aa, unknown, or other
LFIDEIHLVLGAGRTEGSMDAANLFKPMLARGQLRCIGATTLEEYRKYVEKDAAFERRFQQVFVAEPSVADTVSILRGLKEKYEGHHGVRIQDRALVVAAQLSARYIMGRHLPDKAIDLVDEACANVRVQLDSQPEEIDNLERKRIQLEVELHALEKEKDKASKARLVEVRKELDDLRDKLQPLTMKYRKEKERIDEIRKLKQRREELMFSLXEAERRMDLARVADLKYGALQELDA

SEQ ID NO: 49727 - DNA, 658 bp, Panicum virgatum
  misc_feature: Ceres CLONE 2051783
  misc_feature: Encodes the peptide sequence at SEQ ID NO. 49728
aatcgccaaggccaggcccgccgcgcagagtggactgactggtcactggtagctcgatcgatcggatcatcggaggcaggcatggcgtccgggaagcacttcaagtacgtcatcctcggcggcggcgtcgcggcggggtacgcggcccgggagttcgccaagcagggagttcagccaggggagctcgccatcatctccaaggaggcggtggctccatacgagcgtcctgccctcagcaagggttacctcttccctcagaatgctgcaaggctcccaggattttatgtgtgtgtcggaagtggtggagagaggctattgcctgaatggtactcagagaaaggtacaaatcaaaattctcttacagactttacagtgttaaatcgcgtttcaatgcttttgtgacctggagttgtatccttcattttacactgtccatttgaacttagctgctgcctgctgggcagtcctttaaggagtatgcttgatggaacttcaaattttccaacctagcttgtaaagctatcacctgttcacccatatctagttcactgtatcggcacaatatgagggtgccttgctgctttacccttacaaatttccagttcactgatgagaaatgtttgttttataatgatatgtttgtttggctgaatgttcg

SEQ ID NO: 49728 - protein, 106 aa, Panicum virgatum
  misc_feature: Ceres CLONE 2051783
  misc_feature: SWISSPROT Homolog: EC 1.6.5.4 Monodehydroascorbate reductase (NADH)
MASGKHFKYVILGGGVAAGYAAREFAKQGVQPGELAIISKEAVAPYERPALSKGYLFPQNAARLPGFYVCVGSGGERLLPEWYSEKGTNQNSLTDFTVLNRVSMLL

SEQ ID NO: 49729 - DNA, 713 bp, Panicum virgatum
  misc_feature: Ceres CLONE 2051797
  misc_feature: Encodes the peptide sequence at SEQ ID NO. 49730
gagaagcatcgtcgctcatctatcaaacctgagtctgtcaccacggtttggccggaaactaaaagcctgttcagcctcttgtcacttacattcaccaagaaactatgagctgctacttcccactgggaaccatgctttgggtcctatgcgtcttgcagttcatgttccacatggcaggtggctgcgtaatcgaggagaggattgctcttatgcgcatcagatctttgctggtggaggcaaactctgaagttcctgcttcttggggacggagtgacgactgctgctcctggaaatgggtccgttgcaacaacagcacacgagtgtcgggtctcaacctcgactccgtgtaccatacaaaggatcagaactgcctttttgcaatggaacttggaggtccatgctgctggaatctcaatttgaccgtattttcctcgtttcatgagcttcagcagctggatttttctttgaatgccgcctgtcttcaaaattttgatggccttcaaggattgactaagcttcgctatctcaacctcagctacaacagcttggtcgagaataataccttggaatctcttggtaaattggcttctctagaagtcataaattttgagcaaactggtttgagcggtgctcttcagaatattgctttcagaaatctcaagaacttgcgagatttgcgtctaggatccaaatcaatggacggaagcatcccc

SEQ ID NO: 49730 - protein, 202 aa, Panicum virgatum
  misc_feature: Ceres CLONE 2051797
  misc_feature (28)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MSCYFPLGTMLWVLCVLQFMFHMAGGCVIEERIALMRIRSLLVEANSEVPASWGRSDDCCSWKWVRCNNSTRVSGLNLDSVYHTKDQNCLFAMELGGPCCWNLNLTVFSSFHELQQLDFSLNAACLQNFDGLQGLTKLRYLNLSYNSLVENNTLESLGKLASLEVINFEQTGLSGALQNIAFRNLKNLRDLRLGSKSMDGSI

SEQ ID NO: 49731 - DNA, 683 bp, Panicum virgatum
  misc_feature: Ceres CLONE 2051827
  misc_feature: Encodes the peptide sequence at SEQ ID NO. 49732
agtcatcatcactcctcccgtctcgtcttcgtctccgcgctttagtcgagagttttttttttttgtcccgtcctcctccgcccctcgatcgctgatccggtgctatggatcgcgaagaagtgactgaattcctggggcaggtgcccctcctgcagtgcctcccgggctcctccatccgcaggatcgccgaggtcgtccaggtcaagcgctacgaacctggtgattatgtcgcccgcgaaggtgaacctgtacatggcatttacatgatattggatggtcaggctgaagtttctgcatctgcgaacgcagaagaagcaaaccgcccagactgtgtgttaaataagtatgactactttggttatggaacaaatagttctgatcatcaagttaatgttgtagcactatcaaagctgacctgcttcatattgcccaatcaatttggatatttgttacaagcaaaaacaatttggaatgcggagacacctgaacattctttgctggaacaaattttgcatttagaaccactagaggtcgatatcttccgtgggtttactttaccagaagctccaatttttaggcaagtttttggaggacaattgatcggacaggcactttttctaccacgctctcttacttctgcaatctagattttttgaacatatttatttgcccactttcatttc

SEQ ID NO: 49732 - protein, 180 aa, Panicum virgatum
  misc_feature: Ceres CLONE 2051827
  misc_feature (33)..(121): Pfam Name: cNMP_binding Pfam Description: Cyclic nucleotide-binding domain
  misc_feature: SWISSPROT Homolog: EC 2.7.11.12 cGMP-dependent protein kinase
MDREEVTEFLGQVPLLQCLPGSSIRRIAEVVQVKRYEPGDYVAREGEPVHGIYMILDGQAEVSASANAEEANRPDCVLNKYDYFGYGTNSSDHQVNVVALSKLTCFILPNQFGYLLQAKTIWNAETPEHSLLEQILHLEPLEVDIFRGFTLPEAPIFRQVFGGQLIGQALFLPRSLTSAI

SEQ ID NO: 49733 - DNA, 677 bp, Panicum virgatum
  misc_feature: Ceres CLONE 2051835
  misc_feature: Encodes the peptide sequence at SEQ ID NO. 49734
acacgccgagacttgctcttcttcttgttgttgttgaggaatagatagatagaattctggggcagccggggcccgagatcggcgaggagccgtccggccggccgtgcttgcttgcgccattgatacatccatccatctcatctactagagagggagttgtagcagcagatccacccaacacaatggagacccgggacagcgttccctccaccacgccgctcccctacgcctactcgccgctcccggccgccgacgccgcctccgccgaggtctccggcagcgccaacggccgccgcaggccgctctgcgccgccgcgctcgtgctgtccgccgcgctgctcctggccgtcgcggcgctggccggcgtccgcatcgcgcccccgcgccccatcacggtgggagtgggagagacgacgactgcggcggcggcggcggcgaggagaaggggccccgcggccggcgtgtcggagaagacgtccggcgcgcaggggatgctgcgcggcggcaacgccttcccctggagcaacgcgatgctgcaatggcagcgcacgggattccacttccagccgcagaagaactggatgaacgatcccaacggccctgtgtactacaaggggtggtaccacctcttctaccagtacaaccccgacggcgccatctggggcaacaagatcgcg

SEQ ID NO: 49734 - protein, 164 aa, Panicum virgatum
  misc_feature: Ceres CLONE 2051835
  misc_feature: SWISSPROT Homolog: EC 3.2.1.26 Beta-fructofuranosidase
  misc_feature: Functional homolog of the protein sequence given in SEQ ID NO 51130
  misc_feature: Useful for making plants with altered carbohydrate content
METRDSVPSTTPLPYAYSPLPAADAASAEVSGSANGRRRPLCAAALVLSAALLLAVAALAGVRIAPPRPITVGVGETTTAAAAAARRRGPAAGVSEKTSGAQGMLRGGNAFPWSNAMLQWQRTGFHFQPQKNWMNDPNGPVYYKGWYHLFYQYNPDGAIWGNKI

SEQ ID NO: 49735 - DNA, 772 bp, Panicum virgatum
  misc_feature: Ceres CLONE 2051849
  misc_feature: Encodes the peptide sequence at SEQ ID NO. 49736
aaagccactctctcgctcactctatttccgttctcaccctctccctccgctcgccactaaccacccgcgccacactcgtttctcaaccccctctcagctcggctccctctgctcctttcccctgcgccgggccgcaggagcgacgccatcttccttcccgtcatctccgatggggaacccgcccgagctgtaccacaagatcctcaacatccccaaggacacctcgccgcaggagatccgcaccgcgtacaagaacctcgtcaagaaatggcaccccgacaagcacccgccgtcgtccaagcccgaggccgaggcgcgcttcaaggccatcagtgaggcctacgaggcgctcctggaccagcaggagaacagggcggtgttcgggctgtgcaacgacggccgggccggcgagagggccggcggcggcggcctcggcgccggcgtcgggccgcgcatggagaggacgcgcagcgacgacttctgcacgaggagcgcgcccggcacgccggcgagggagttcaagaaggtgtacagctccggcaactccggcgggcggcgcgccttcgccgagttctccagctccatcatgcgcaaggcgccgccgctggagcgcaagctcgagtgcaccctcgaggagctctgccgcggctgcaagaaggaggtcaagttcacccgcgacgtcgtcaccaaaaacgggtacctgctgctttcctctgcttttcctctcccttttgacgcggctacacctaatccatgaacaagaggttgattg

SEQ ID NO: 49736 - protein, 195 aa, Panicum virgatum
  misc_feature: Ceres CLONE 2051849
  misc_feature (7)..(72): Pfam Name: DnaJ Pfam Description: DnaJ domain
MGNPPELYHKILNIPKDTSPQEIRTAYKNLVKKWHPDKHPPSSKPEAEARFKAISEAYEALLDQQENRAVFGLCNDGRAGERAGGGGLGAGVGPRMERTRSDDFCTRSAPGTPAREFKKVYSSGNSGGRRAFAEFSSSIMRKAPPLERKLECTLEELCRGCKKEVKFTRDVVTKNGYLLLSSAFPLPFDAATPNP

SEQ ID NO: 49737 - DNA, 668 bp, Panicum virgatum
  misc_feature: Ceres CLONE 2051865
  misc_feature: Encodes the peptide sequence at SEQ ID NO. 49738
agttgacttccagccgagctgcgagctctcgctgttcctgctattcctgtccttggattccgcccctcgcgccggccaggagggagatgacgggtggcgcagggaggccggcgggggcgccggaagccgccgagctcgaggagaggctgctcccgctgccgtcgccggggagcggagacgctgacggcggcggcggcggcgggaggaggagggggaagtgggagaagacctacctggacgtgctgggcgtgtgctgctccgcggaggtggccctcgtcgagcgcctcctctcgccgatcgacggcgtgagggccgtcaccgtcgtcgtcccctcccgcaccgtcatcgtcgagcacgaccccgccgccgtctccccgtcccacatcgtgaaggctctgaacaaggccggcctggaggcctcggtgcgcgcgtacggcagcagcggggtggtcgccggccggtggcccagcccgtacgtcctcgccagcggcgccctcctcctcgcctccttcctcgcgccgctcctgcccccgctgcgctggctggccctggcggcggcctgcgccggcgcgccgccgatgctgctccgggcgttcgccgcggccaccgggctcgccctcgacatcaacgtgctcatggtcgtcgcggtggccggcgccaccgcgctc

SEQ ID NO: 49738 - protein, 193 aa, Panicum virgatum
  misc_feature: Ceres CLONE 2051865
  misc_feature: SWISSPROT Homolog: EC 3.6.3.4 Copper-exporting ATPase
MTGGAGRPAGAPEAAELEERLLPLPSPGSGDADGGGGGGRRRGKWEKTYLDVLGVCCSAEVALVERLLSPIDGVRAVTVVVPSRTVIVEHDPAAVSPSHIVKALNKAGLEASVRAYGSSGVVAGRWPSPYVLASGALLLASFLAPLLPPLRWLALAAACAGAPPMLLRAFAAATGLALDINVLMVVAVAGATA

SEQ ID NO: 49739 - DNA, 654 bp, Panicum virgatum
  misc_feature: Ceres CLONE 2051872
  misc_feature: Encodes the peptide sequence at SEQ ID NO. 49740
aaaaatcaaaagccacggttgttctcttgttccaatgcagattgatgggtgggagcagccaagatcactcatgggcttgattgagtaattcctccctttcctccatgccaatctcgtaatccctagtcccaacccaaccacactcgcatttgcaaacagcaacaatggcgctgcagttcttgctgcgttccatggggttactggcgatcttggcgtgcctgagcttggaaatgccaacggcggcagcagctgctaccgttccgcagccggagcccgaggtgaagccgagcgacacggacgcgctcaccatcttccgccacggcgccgacgcgcacggcatcctggccgccaactggagcaccggggacgcctgcgccggccgctggacgggcgtcggctgctccgccgacggccgccgcgtcacctcgctcgcgctcccgtcgctggacctgcggggcacgctcgacccgctctcccatctcgccgagctccgcgcgctcgacctccgcgggaaccgcctcaacggcacgctcgacgcgctcctccgcggcgtccccaacctcgtgctgctctacctctcccacaacgacatctccggcgccatccccgacgacgtcgcccggctcacgcggctcgtccgtgtggacctcgctg

SEQ ID NO: 49740 - protein, 163 aa, Panicum virgatum
  misc_feature: Ceres CLONE 2051872
  misc_feature: SWISSPROT Homolog: EC 2.7.11.1 Non-specific serine/threonine protein kinase
MALQFLLRSMGLLAILACLSLEMPTAAAAATVPQPEPEVKPSDTDALTIFRHGADAHGILAANWSTGDACAGRWTGVGCSADGRRVTSLALPSLDLRGTLDPLSHLAELRALDLRGNRLNGTLDALLRGVPNLVLLYLSHNDISGAIPDDVARLTRLVRVDLA

SEQ ID NO: 49741 - DNA, 705 bp, Panicum virgatum
  misc_feature: Ceres CLONE 2051874
  misc_feature: Encodes the peptide sequence at SEQ ID NO. 49742
ctagtcagccggatcgctgcgtcgctccgcctcggccttccgccctcgcgcggcgccttcctcggttcgtcggtccagcttgggagatgtcggactctgaggagcaccatttcgagtcgaaggccgacgccggagcctccaagacttacccgcagcaggccggcaccatccgcaagaacggatacatcgtcatcaagggccgcccgtgcaaggttgttgaggtctccacttcaaagacagggaagcacggtcatgcgaaatgccacttcgtggccattgacattttcaatggaaagaagcttgaggatattgtgccatcctcccataactgtgatgtgccccatgtcaaccgtactgactatcagctgattgacatatctgaagatggatttgtaagccttctgactgaaaatggaggcaccaaggatgatctgaggctccctactgatgaaactctgctttcccagattaaagctggattcgatgatgggaaggttattcctgatgttgcagcgtttccctgtagaatcaaaaggaaggtgtaagaaattgcaggaggttggctatgtgactacaatctgcttttcttgcttcttgatcagatgcgtcatgatgtgccttaatgcatttgataaagctgcagatcttgatgttctgaaccatccgatcctgaacttcttctattacttgctggttgagatcgtg

SEQ ID NO: 49742 - protein, 152 aa, Panicum virgatum
  misc_feature: Ceres CLONE 2051874
  misc_feature (86)..(149): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGYIVIKGRPCKVVEVSTSKTGKHGHAKCHFVAIDIFNGKKLEDIVPSSHNCDVPHVNRTDYQLIDISEDGFVSLLTENGGTKDDLRLPTDETLLSQIKAGFDDGKVIPDVAAFPCRIKRKV

SEQ ID NO: 49743 - DNA, 655 bp, Panicum virgatum
  misc_feature: Ceres CLONE 2051913
  misc_feature: Encodes the peptide sequence at SEQ ID NO. 49744
aagcagacattgttagcacagcttaggcatgtgctagctagctagcttttctgctggaccagctagcagatcgaggtgtgaaattaaaggtgatcatcaggtgatcagcagcacagggtgcgtgcggtgggggtgccggcagggtgtggtgatcgcgatcgatccatccatcccatggcggcggcggcggcggcggcggtggttgagaggctggtgttcgcgttgaacgggcggcggtacgaggtggccgcgcgccgacgtggacccgtcgacgaggctggtggagttcatccggacgcggacgccgttcaagggcaccaagctcggctgcggcgaaggtggttgtggggcttgtgttgtccttatagcaaagtataaccccaagacggatgaagtgactgaatttaacgcaagttcatgcctgacacttctttatagtataaatttatgttcagttatcacgactgagggtctggggaatactcaggatggctttcatgctgttcagaaaaggatgtctgggtttcatgcctctcagtgtggcttctgcactcctggaatgtgcatgtctattttcacctcccttatcaatgctgacaaatccaagaggcccgaaccaccaaaagggttctcaaaactaaaagtatcagaagca

SEQ ID NO: 49744 - protein, 46 aa, Panicum virgatum
  misc_feature: Ceres CLONE 2051913
  misc_feature: SWISSPROT Homolog: EC 1.2.3.1 Aldehyde oxidase
MSGFHASQCGFCTPGMCMSIFTSLINADKSKRPEPPKGFSKLKVSE

SEQ ID NO: 49745 - DNA, 567 bp, Panicum virgatum
  misc_feature: Ceres CLONE 2051916
  misc_feature: Encodes the peptide sequence at SEQ ID NO. 49746
accaagactcgccgctcgccgctcgccgccagcatctcgcgtcccgacaatctgccgcagaagaatcggccccagtccccgtctcttctcctcctcctcctccccctccttccccattctaccagccgcggccatggccaccgacagcgccgcccccgccgggtccaagagtaagctgctcgtcttcgattccgtggaagatctcgcggtgtctctggcgaagtacaccgctgagctgtctcagaagttcgccaccgagaggggcgccttcaccgtcgtgctctccggcggatccctcatcgactcgctcagcaagctgacggagccgccgtacctggaatcggtggactggagcaagtggcacgtcttctgggtggatgagagagtcgtgcccaaggatcatgaggatagcaactacaagctcgccttcgatgggtttctctccaaggtattctttgcaatttattgtgcttttttcaaggcaattcctgttctctgattgggtaattgggagacgggatcttgttgtgtagggtgatggggagtgcagagtgaagcgaacaactc

SEQ ID NO: 49746 - protein, 165 aa, Panicum virgatum
  misc_feature: Ceres CLONE 2051916
  misc_feature: SWISSPROT Homolog: EC 3.1.1.31 6-phosphogluconolactonase
PRLAARRSPPASRVPTICRRRIGPSPRLFSSSSSPSFPILPAAAMATDSAAPAGSKSKLLVFDSVEDLAVSLAKYTAELSQKFATERGAFTVVLSGGSLIDSLSKLTEPPYLESVDWSKWHVFWVDERVVPKDHEDSNYKLAFDGFLSKVFFAIYCAFFKAIPVL

SEQ ID NO: 49747 - DNA, 751 bp, Panicum virgatum
  misc_feature: Ceres CLONE 2051917
  misc_feature: Encodes the peptide sequence at SEQ ID NO. 49748
aagcacagcattcattcattcggtccttagccaattagctagccaaggagagagctcgtcgatcagccgtcgagtgtctcggccgggcgagagcacaagaaaaggcaacaatggctacctcctaccttctccgttgctcttccctcgtcgctgtgctcgtgctgctcttctccatcggcatgacggagggcgccattagggagtaccagttcgatgtgcaaatgacgaacgtgacgcggctgtgtagcagcaagagcatcgtgacggtgaacgggcagttcccggggccgacggtgtttgccagggagggcgacctcgtcgtcgtccgcgtcgtcaaccacgtcccctacaacatgagcatccactggcacggcatccggcagctgcggagcgggtgggcggacggcccggcgtacatcacgcagtgcccgatccagagcgggcagagctacgtgtacaagttcaccatcaccgggcagcgcggcacgctgtggtggcacgcgcacatctcctggctccgcgccaccgtctacggcgccatcgtcatcctccccaagcccggcgtcccctacccgttcccggcgcccgacaaggaggtccccatcatgttcggcgagtggtggacggcggacacggaggcggtgatcagccaagcgctccagaccggcggaaggcccaacgtctccgacgctttcacatcaacggccttcctgggccgctctacaactgctccgccaaagacacgttcaag

SEQ ID NO: 49748 - protein, 213 aa, Panicum virgatum
  misc_feature: Ceres CLONE 2051917
  misc_feature (35)..(151): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 50392
  misc_feature: Useful for making plants with altered carbohydrate content
  misc_feature: Functional homolog of the protein sequence given in SEQ ID NO 50393
  misc_feature: Useful for making plants with altered cell wall content and/or composition
  misc_feature: Functional homolog of the protein sequence given in SEQ ID NO 50394
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MATSYLLRCSSLVAVLVLLFSIGMTEGAIREYQFDVQMTNVTRLCSSKSIVTVNGQFPGPTVFAREGDLVVVRVVNHVPYNMSIHWHGIRQLRSGWADGPAYITQCPIQSGQSYVYKFTITGQRGTLWWHAHISWLRATVYGAIVILPKPGVPYPFPAPDKEVPIMFGEWWTADTEAVISQALQTGGRPNVSDAFTSTAFLGRSTTAPPKTRS

SEQ ID NO: 49749 - DNA, 737 bp, Panicum virgatum
  misc_feature: Ceres CLONE 2051925
  misc_feature: Encodes the peptide sequence at SEQ ID NO. 49750
cttttttcttctctgctctcggtctcggtttccccctcccatcccatctcctcccttgccgccgggctccccaaacccaacaatctcccaagaaaaggcccctcccgccgccgccggagatactctgccttcctccgcgacggccatcgcccgccataccgtacatggcagccgtggggcccgtcccctggcagtggcagccttcctcggcgctggcgctggagcctgcggggctcctcgccgcgacctccccatccggcaatcatgagccccaaaccctacctttcttgcccccgccgccgcctgcggggtacccgctccttcctccccgggccccgatcgtcctccagctccacccccaccccggcttcctcgccgacgtggatcgccgccgcagctgttccctcttgaagctcttgaaggatgagggggccgccccgtcgccagagaatgaaaagaggagggagcaggtcatccgagagctcaagaaggtaatggcgctcgggatgcttgcttggtcaaagaaagaatcttgccaattaggtaggtgccctcgcccctccctggatttctgacgtgctcgcttctctcagattgtgatgcgttgggccaaggcggtggcgcgtgagcagagtgtgccccagaggatggccacggctacggtcttgacatacggttcttactcattaggggctcatggacctgaatctgacattgacgcactttgtgttggggct

SEQ ID NO: 49750 - protein, 45 aa, Panicum virgatum
  misc_feature: Ceres CLONE 2051925
  misc_feature: SWISSPROT Homolog: EC 2.7.7.19 Polynucleotide adenylyltransferase
MRWAKAVAREQSVPQRMATATVLTYGSYSLGAHGPESDIDALCVG

SEQ ID NO: 49751 - DNA, 713 bp, Panicum virgatum
  misc_feature: Ceres CLONE 2051934
  misc_feature: Encodes the peptide sequence at SEQ ID NO. 49752
gttcggccaaatcccctcccagaaccctagctcccgccgccggccgccgcgcccccgcccgcggccccggatggccggcgccgccgcgctccggcgatccgctcgccggattgcgcgtcacgtcgccgccgccccgtccctgtcccggaacgcgctccagcagccggagcgcctgctctcgtcgcaggcgtctccggagcacgggccccgcgccgcggtgtccgggtccgagctcgcgctgtacccgccggagcgggtccggaacttctcgatcatcgcgcacgtcgaccacggcaagtcgacgctcgcggaccggctgctggagctcaccggcaccatccagaagggccatggtcagccccagtacctcgacaagctgcaagttgagagagaaaggggaattacagtcaaagcacaaacagcaactatgttctataggcacactactgcgtcccaggaatcagatgcgccaagatatttgcttaatctaatcgacacgccaggccatgtggatttcagctatgaggtatccaggtcccttgcagcttgccagggtgctcttttagtagttgatgcagcacaaggtgtacaagctcaaacaattgccaacttttaccttgcatttgaatcaaatttgagcatcattcctgtgatttaacagattgatcagccaactgctgatccagataatgtaaaggatcaattgaagcggt

SEQ ID NO: 49752 - protein, 195 aa, Panicum virgatum
  misc_feature: Ceres CLONE 2051934
  misc_feature (61)..(194): Pfam Name: GTP_EFTU Pfam Description: Elongation factor Tu GTP binding domain
  misc_feature: SWISSPROT Homolog: EC 2.7.7.4 Sulfate adenylyltransferase
MAGAAALRRSARRIARHVAAAPSLSRNALQQPERLLSSQASPEHGPRAAVSGSELALYPPERVRNFSIIAHVDHGKSTLADRLLELTGTIQKGHGQPQYLDKLQVERERGITVKAQTATMFYRHTTASQESDAPRYLLNLIDTPGHVDFSYEVSRSLAACQGALLVVDAAQGVQAQTIANFYLAFESNLSIIPVI

SEQ ID NO: 49753 - DNA, 726 bp, Panicum virgatum
  misc_feature: Ceres CLONE 2051945
  misc_feature: Encodes the peptide sequence at SEQ ID NO. 49754
atgcgtccacccttcgatctcgccgaggccgagggaggagacgactaggagtctactgttccagagaagaaagcgaagaggagaatcctggagagcagagctgctgccgctgctacttcggttggtggatcgaatcgatccccgcttgatgctgcccctgtgctactgaggaaaggagggggaagggatctgagggaggagcaggatgtcgtcgtcctcgtcggcggtgtacgaggggtggatggtccgttacggccggcgcaagatcggccggtccttcgtccacacccgctacttcgtgctggagccgcggatgctgtcctactacaagcgcaagccgcagcacaaggcggacaaggtcggggggaagctgcccatcaagtccctccccatcgacggcaactgcagggtcgaggacagggggctcaagatgcaccacggacacatgctttatgtcttgtgcgtctacaacaaaagggagaagcacaaccgcatcacgatggcggcgttcaacatacaggaggctctaatttggaaggagaaaatcgagatggtcattgatcagcaacaaggagcagcacaaagtgatggcaacagggctattagctcatcgcagcaaaaggctagcttagaaaatggaaggaaatcttcttcctctgaccacgaaagtcagtacagtaatgaagaagaggaagaagaggaggaaaatcagcgatcattgctaag

SEQ ID NO: 49754 - protein, 173 aa, Panicum virgatum
  misc_feature: Ceres CLONE 2051945
  misc_feature (7)..(119): Pfam Name: PH Pfam Description: PH domain
MSSSSSAVYEGWMVRYGRRKIGRSFVHTRYFVLEPRMLSYYKRKPQHKADKVGGKLPIKSLPIDGNCRVEDRGLKMHHGHMLYVLCVYNKREKHNRITMAAFNIQEALIWKEKIEMVIDQQQGAAQSDGNRAISSSQQKASLENGRKSSSSDHESQYSNEEEEEEEENQRSLL

SEQ ID NO: 49755 - DNA, 701 bp, Panicum virgatum
  misc_feature: Ceres CLONE 2051971
  misc_feature: Encodes the peptide sequence at SEQ ID NO. 49756
aaactagggtttttcggacctcgcatcctgctcctgacctcctccccttcgcgccgccgccgccaggagccgcgcccaagctcgagcgccagccatggccttcggagctctcgtcgcctcgaggctggccaggtccggccgcaccctcgcctccgccgttgcccaggctcccgcggcacagcgaacggcgcctcctctgctctccaggctcggagctgtagctcgtgctctcagcacaaagccggcggcggcagatgtcatcgggatcgatctgggcacaacgaattcctgcgtctccgtcatggagggaaagacaccacgggtgattgaaaatgcagaaggcgcgaggacaacgccgtccattgttgccaagaatcagaatggtgacctgcttatcggtatcactgcgagccggcaagcggtgaccaacgcccagaacacaatctgtgggtcgaagcgtctgattggtaggacttttgatgacccacagacccagaaggagatgaagatggtgccttacaagattgtgagggcaccgaacggtgatgcctgggtggagatgggtggccagaagtactccccaagccagatcggtgcatttgttctcaccaagatgaaggaaactgcagaggcttaccttggcaagacagtctccaaggctgttattaccgtcccagcttatttcaatgatgctcagcgtc

SEQ ID NO: 49756 - protein, 202 aa, Panicum virgatum
  misc_feature: Ceres CLONE 2051971
  misc_feature: Functional homolog of the protein sequence given in SEQ ID NO 50336
  misc_feature: Useful for making plants with modulated heat sensitivity
MAFGALVASRLARSGRTLASAVAQAPAAQRTAPPLLSRLGAVARALSTKPAAADVIGIDLGTTNSCVSVMEGKTPRVIENAEGARTTPSIVAKNQNGDLLIGITASRQAVTNAQNTICGSKRLIGRTFDDPQTQKEMKMVPYKIVRAPNGDAWVEMGGQKYSPSQIGAFVLTKMKETAEAYLGKTVSKAVITVPAYFNDAQR

SEQ ID NO: 49757 - DNA, 713 bp, Panicum virgatum
  misc_feature: Ceres CLONE 2051974
  misc_feature: Encodes the peptide sequence at SEQ ID NO. 49758
aaaagaccgccgctgcctgcgcaccacccaggcctcagctcgagcccaacgaccggcgcctagacgcggctgggcggtcggcctcacctcccctcccccgcgcctccctcctccgcgtctcgatctcgcctcccgccacccgcccagatctcgccatcccggcgctgcggccatggagaacctgatctccctcgtcaacaagctgcagcgggcctgcacggccctcggcgaccacggcgaggagagcgccctcccaacgctctgggactcgctgccggccatcgccgtcgttggaggccagagttctggcaaatcttcggtgttggagagtgtggtcgggaaggatttcctaccgaggggttcaggcattgtcacccggcgtccgctggtgctgcagctccacagaattgatggagacagggaatatgctgagtttatgcaccaacccaggaagagatatacagattttgctgctgtgaggaaggagatagctgatgaaactgacagagaaactggtcgctcaaagcaaatatcacctgtccctatccatttaagcatctattctccaaatgttgtgaatctgactcttgttgatcttcctgggcttactaaagtagctgttgagggtcaaccagacagtattgttcaagacatcgaaaacatggttcgatcatacattgaaaaagcaaattgtatcattttggccgtttccc

SEQ ID NO: 49758 - protein, 180 aa, Panicum virgatum
  misc_feature: Ceres CLONE 2051974
  misc_feature (37)..(180): Pfam Name: Dynamin_N Pfam Description: Dynamin family
  misc_feature: SWISSPROT Homolog: EC 3.6.5.5 Dynamin GTPase
MENLISLVNKLQRACTALGDHGEESALPTLWDSLPAIAVVGGQSSGKSSVLESVVGKDFLPRGSGIVTRRPLVLQLHRIDGDREYAEFMHQPRKRYTDFAAVRKEIADETDRETGRSKQISPVPIHLSIYSPNVVNLTLVDLPGLTKVAVEGQPDSIVQDIENMVRSYIEKANCIILAVS

SEQ ID NO: 49759 - DNA, 512 bp, Panicum virgatum
  misc_feature: Ceres CLONE 2051994
  misc_feature: Encodes the peptide sequence at SEQ ID NO. 49760
aggtataccactccgcaatgaacctcgctgtcgccgctcccgccgccgtgccgggcgtggcgccgcctccccgcgccgcgcgcccgcggtgcgcgcgcctaccccgtcgcggcgggggcctccccgcgcgcgcgggcacgggctcgcctgcctccgcctcaacctcgttgtcgtcgtcgcccgcggcggcggcgcccgtctacgcgcccacgccgcaggaccggccgctccggacgccgcacagcgggtaccactttgacggcaccgccagacctttctttgagggatggtacttcaaggtggccataccagaatgcaggcagagcttctgcttcatgtactccgttgagaacccactgttccgtgacgggatgagtgatcttgacaagttggtacacggtccacgctttactggcgtgggagcacaaatccttggcgcggatgataagtacatatgccaattctctgagaaatcaaataacttttggggaagtaggcatgaactaatgctg

SEQ ID NO: 49760 - protein, 164 aa, Panicum virgatum
  misc_feature: Ceres CLONE 2051994
  misc_feature: Functional homolog of the protein sequence given in SEQ ID NO 51777
  misc_feature: Useful for making plants with altered tocopherol content
MNLAVAAPAAVPGVAPPPRAARPRCARLPRRGGGLPARAGTGSPASASTSLSSSPAAAAPVYAPTPQDRPLRTPHSGYHFDGTARPFFEGWYFKVAIPECRQSFCFMYSVENPLFRDGMSDLDKLVHGPRFTGVGAQILGADDKYICQFSEKSNNFWGSRHELM

SEQ ID NO: 49761 - DNA, 645 bp, Panicum virgatum
  misc_feature: Ceres CLONE 2052022
  misc_feature: Encodes the peptide sequence at SEQ ID NO. 49762
aaatcgctcctcggcaaaaagcacagagagttccaaagcaaagcaacaatgggtatgcttcacatcttcatccaaatagccatagccctgctcgtttttacccacaccatgagctgcacacaggcatctacccagacaaataatgctaccgtcatgaagtgtatagcccatgagcgttcagctctcctcacgttcagtgccggcctatcagaccctgcaaaccttctttcatcatgggaaggtggcaactgctgccaatggaagggtgtccagtgcagcaacacaacaggtcatgttgttaagctcgatcttcaaggccctgactgcgacaacagtgatgcgagtatgcaagtgcttggaggtaagataagctcctcactgattggtttgcagcacttgcagtatctcgatcttagctgcaacaggtttaacaatgagacaatatcggagttcttgggctctctccatggtttgagatatcttgacctatcgctgtcgagctttgttggaaggataccaccacagctgggtaacctctccaacctgcgttacttgaatcttgattccgtttttggtgacactcactccatggatatcacctggctgtcacggttatcttaccttcagcacctcgatatgagctgg

SEQ ID NO: 49762 - protein, 198 aa, Panicum virgatum
  misc_feature: Ceres CLONE 2052022
  misc_feature (39)..(77): Pfam Name: LRRNT_2 Pfam Description: Leucine rich repeat N-terminal domain
  misc_feature: SWISSPROT Homolog: EC 2.7.11.1 Non-specific serine/threonine protein kinase
MGMLHIFIQIAIALLVFTHTMSCTQASTQTNNATVMKCIAHERSALLTFSAGLSDPANLLSSWEGGNCCQWKGVQCSNTTGHVVKLDLQGPDCDNSDASMQVLGGKISSSLIGLQHLQYLDLSCNRFNNETISEFLGSLHGLRYLDLSLSSFVGRIPPQLGNLSNLRYLNLDSVFGDTHSMDITWLSRLSYLQHLDMS

SEQ ID NO: 49763 - DNA, 676 bp, Panicum virgatum
  misc_feature: Ceres CLONE 2052034
  misc_feature: Encodes the peptide sequence at SEQ ID NO. 49764
atcgagcgagccagcaattgtccgatccgtgccgtgctcccccgccgccgccgccgcttcctcctcctcaccgcttcgtcgattcggttcgctgcttcccgcgtcaaatcaccgcctcgcggatggcctccaacgccccggcgccccagccccaggccctgcccaagcccactagggtctcgctgtcctacgaggagatctccaagctcttctcgctccccatcgccgagtcagcctccatcctcggagtctgcaccagtgtcttgaagaggatttgccgcagccacgggattgttaggtggccgtatcgaaagcttgtttctgggaaagctggtgacgacacaaaaggtcctgaaagagagaaagccaaggagcttcttgagttgtcaaaaattgcaaaacaaaaggctttcagcccatctggttcatcagtagcgtgagtaaagctctccctccctccctccctacctacttctcacgctctgcaaagcttgagtaggctcatgcagttgtcttactgagtgttcaacgccacttggtagtgccactttaaataaaaacctatgaaatatactgaagtattgttgaaaacatatgcctgaagcgcaatgttgtttcagtcatgtaactaattctgtgtcaggtttgacacatcagcataatttaacaatttaag

SEQ ID NO: 49764 - protein, 105 aa, Panicum virgatum
  misc_feature: Ceres CLONE 2052034
  misc_feature (17)..(68): Pfam Name: RWP-RK Pfam Description: RWP-RK domain
MASNAPAPQPQALPKPTRVSLSYEEISKLFSLPIAESASILGVCTSVLKRICRSHGIVRWPYRKLVSGKAGDDTKGPEREKAKELLELSKIAKQKAFSPSGSSVA

SEQ ID NO: 49765 - DNA, 728 bp, Panicum virgatum
  misc_feature: Ceres CLONE 2052078
  misc_feature: Encodes the peptide sequence at SEQ ID NO. 49766
gtcggctcgccgtctctcttcctccagatctcggcgcgagttcacccgctgcagatttccatttccacaccaagacgaaggagaggtgggattcggaggactaaaccctaaccgccgtctcgcggcggtggttcggtgcccgcgcgagatccgggtggagatctagggcgcggcgccggccatggcgagctccggactcgcctaccctgaccgcttctacgccgccgcggcctacgccgggttcggccccggtggggccacctcctcggcagctatctcccgcttccaaaacgacgtcgccctcctcctctacggcctacaccagcaggccacagttggtccgtgcaatgtgcccaagccaagggcatggaaccccgtggagcagagcaaatggaccagttggcatgggcttggaagcatgccatcagcagaggcgatgcgtctttttgtcaaaatcttggaggaggaagatcctggatggtactctagggtccctgagttcaattctgagcctgttgtggatatccaaatgcataaaccaaaagaagagccacaggttgtaccagcttcaacaaatggaacattattttcagaaccaaaaatcatttctgagaatggaagttctgtggaaacacaggacaaagatgttattcaggaaggccttagtactgttagttctcatgacgaatggactccattatctatcagtggtcatcgtccgaagcctg

SEQ ID NO: 49766 - protein, 182 aa, Panicum virgatum
  misc_feature: Ceres CLONE 2052078
  misc_feature (8)..(97): Pfam Name: ACBP Pfam Description: Acyl CoA binding protein
  misc_feature: SWISSPROT Homolog: EC 5.3.3.8 Dodecenoyl-CoA isomerase
MASSGLAYPDRFYAAAAYAGFGPGGATSSAAISRFQNDVALLLYGLHQQATVGPCNVPKPRAWNPVEQSKWTSWHGLGSMPSAEAMRLFVKILEEEDPGWYSRVPEFNSEPVVDIQMHKPKEEPQVVPASTNGTLFSEPKIISENGSSVETQDKDVIQEGLSTVSSHDEWTPLSISGHRPKP

SEQ ID NO: 49767 - DNA, 658 bp, Panicum virgatum
  misc_feature: Ceres CLONE 2052115
  misc_feature: Encodes the peptide sequence at SEQ ID NO. 49768
ggatccattggagggcaagtctggtgccagcagccgcggtaattccagctccaatagcgtatatttaagttgttgcagttaaaaagctcgtagttggaccttgggccgggtcggccggtccgcctttcggcgagcaccgacctactcgacccttctgccggcgatgcgctcctggccttaattggccgggtcgtgcctccggcgctgttactttggagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaaggtggggcgagaagaagaacgtcagaatcgtgttcgggcgatggcaggacgtgatgccacagctcggatcttatgatggtatatttttcgacacttatggggaatactacgaggacatgagagagttccaccaacaccttcctaagctgctgaagcccggagggatctactcatacttcaacggactctgcggtgacaacgcattctttcacgtgg

SEQ ID NO: 49768 - protein, 113 aa, Panicum virgatum
  misc_feature: Ceres CLONE 2052115
  misc_feature: SWISSPROT Homolog: EC 2.1.1.2 Guanidinoacetate N-methyltransferase
MINRDSRGHSYFIVRGEILGFMKDEQLRKHLPRMFSLIKNERWGEKKNVRIVFGRWQDVMPQLGSYDGIFFDTYGEYYEDMREFHQHLPKLLKPGGIYSYFNGLCGDNAFFHV

SEQ ID NO: 49769 - DNA, 717 bp, Panicum virgatum
  misc_feature: Ceres CLONE 2052128
  misc_feature: Encodes the peptide sequence at SEQ ID NO. 49770
acagctggggcgcgtggtggttggctggttgcgtttcccccgttcgagaaaaaagggcagagtcctagccgcctggccttggcttttccagctcccggggcttcagcgtacagctgctgctgcccgttgccattcctgtgaaaccgtggtgagagaaagcgggggaggagcctactcctcctgctggggggttcttgattattctttgcaagattggctgcaatcatcgccgccatcatcacgaagcgagcaagccatggcattcgcagatggggacccgtcctcttcttcatcctgctcttcgtgggatagtgacgatgagtaccagaagttcatccaaaagatgaaccctccaagggtaacgattgacaatgcctcatgtgcaaatgctacaaccatccatgtggacagcgccaacaagtatgggatactactggaggtagtgcaggtcctcactgacctcaagctcattgtcaagaaagcctacatatcctctgacgggggatggttcatagatgtgttcaatgtgacaaatcaaagtgggcagaagataatgaacgaatctgcgctggaagggataaaagataacatttacaagtctatcgcgtctagttcttgctttcttccttcacggagggccattggatttgagccttcctccgactacaccttgatagagctaactggaattgacagacccggtcttctctctgaagt

SEQ ID NO: 49770 - protein, 153 aa, Panicum virgatum
  misc_feature: Ceres CLONE 2052128
  misc_feature: SWISSPROT Homolog: EC 2.7.7.59 [Protein-PII] uridylyltransferase
MAFADGDPSSSSSCSSWDSDDEYQKFIQKMNPPRVTIDNASCANATTIHVDSANKYGILLEVVQVLTDLKLIVKKAYISSDGGWFIDVFNVTNQSGQKIMNESALEGIKDNIYKSIASSSCFLPSRRAIGFEPSSDYTLIELTGIDRPGLLSE

SEQ ID NO: 49771 - DNA, 308 bp, Panicum virgatum
  misc_feature: Ceres CLONE 2052129
  misc_feature: Encodes the peptide sequence at SEQ ID NO. 49772
gatgctcgtgcgaaagtcggtactcgtttgattgagctgtttatggaaacagcacatatacagccagctgctagccagtcatcacatggtcttccacaccttcctcctgctttcatacatgacatgacaacagtgccgaaagaacaacacaagcttagtcgcagatgtggtgtcatcgggtgtgatccactggttcggcgaggcccgaatagaacagcaaagcacatggtcatgccttacatgccgatgttgattcccccaatctggtggaccggatatgataaaggagcacacctgtctttaccatc

SEQ ID NO: 49772 - protein, 102 aa, Panicum virgatum
  misc_feature: Ceres CLONE 2052129
  misc_feature: SWISSPROT Homolog: EC 2.7.7.6 DNA-directed RNA polymerase
DARAKVGTRLIELFMETAHIQPAASQSSHGLPHLPPAFIHDMTTVPKEQHKLSRRCGVIGCDPLVRRGPNRTAKHMVMPYMPMLIPPIWWTGYDKGAHLSLP

SEQ ID NO: 49773 - DNA, 735 bp, Panicum virgatum
  misc_feature: Ceres CLONE 2052142
  misc_feature: Encodes the peptide sequence at SEQ ID NO. 49774
atctaaacgcgaaaagctcccccaaacggcaggaagcagcagcagcaggcaggactcatcctcagtctccgtctccgaatccccccgaaatcctctccagttctccggccccgggcaagtctctgccgagtgtgcctcgatccgattggtggacggagtcctgaaccgaggtttgaagtgttgcctgcctcgccggagttttcctcttaccagcgaccgaatcggctcaaaagttcatgggatcgtggggatactggaaagttgtgtgagatcgacgagcgggaaccgtgaattcctaggagggctgcggcgatccggctgcacggctgcatgaactgtttcgagaacctgggactcaactcgaactcgaaccactacgtcgcctgcctcctcatcttcctgctgcatttctcccctcagttgttaaatccgtcaaattctaattcaagtagtactcgtcaaggagaagaacagagctgcacagatggcgaacaacaggcttgctgctgctgatgcgctcaggaacgcgtcattccaggttattcttctggaatcccgtgataggataggtggcagagttcacactgactactcttttgggtttcctgtcgatttgggagcatcttggcttcatggtgtctgtgaagaaaatcccttagcaccaataattggaaggcttggacttccattgtatcgcacgagtggagatgattctgttctgtttgatcatgattt

SEQ ID NO: 49774 - protein, 83 aa, Panicum virgatum
  misc_feature: Ceres CLONE 2052142
  misc_feature (21)..(67): SWISSPROT Homolog: EC 1.5.3.11 Polyamine oxidase
  misc_feature (17)..(50): SWISSPROT Homolog: EC 1.4.3.4 Amine oxidase (flavin-containing)
MANNRLAAADALRNASFQVILLESRDRIGGRVHTDYSFGFPVDLGASWLHGVCEENPLAPIIGRLGLPLYRTSGDDSVLFDHD

SEQ ID NO: 49775 - DNA, 717 bp, Panicum virgatum
  misc_feature: Ceres CLONE 2052157
  misc_feature: Encodes the peptide sequence at SEQ ID NO. 49776
ttccgcccttcgccccccgctcctccgcctcgcgtcgcgtgggaagccaccgcccaggctgcgaagccagcgaagcagctcgctacctttctacctacctctcccggcgtccgtccccagccgcggatccggcttccctctccggcggaaccccttcctgcgccgggccaggtgcggagggggggagcgcgatggcgacgcacgagcggaagacgatcgatctggagcaggggtgggagttcatgcagaagggcatcaccaagctcaagaacatcctcgagggcaagcccgagccccaattcagctccgaggactacatgatgctctacacgacgatttacaacatgtgcacgcagaagccgccgcacgactactcgcagcagctctacgagaagtaccgtgagtcatttgaggagtacatcacgtccatggtcttaccttccttaagggagaaacatgatgaatttatgttgagagagctagtaaaaaggtggtcaaaccataaagtaatggttcggtggctatcacgcttcttccattatcttgatcggtacttcatttcccgaagatcactaccgccgcttagagaagttgggcttagttgtttcagagacttggtatatcaagagatcaaaggaaaagtaaaaagtgcagtcatatctttgattgaccgagaacgtgaaggtgaacaaatagatagggccctgttgaagaatg

SEQ ID NO: 49776 - protein, 175 aa, Panicum virgatum
  misc_feature: Ceres CLONE 2052157
  misc_feature (15)..(175): Pfam Name: Cullin Pfam Description: Cullin family
MATHERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPPLREVGLSCFRDLVYQEIKGKVKSAVISLIDREREGEQIDRALLKN

SEQ ID NO: 49777 - DNA, 633 bp, Panicum virgatum
  misc_feature: Ceres CLONE 2052170
  misc_feature: Encodes the peptide sequence at SEQ ID NO. 49778
attacattctctctccctctgttctctacactctattgttgttctatgttagaaattataaaaaaaaattaaatcatcattagaacgaattttttgctcttttttttaattctttattttatatattttgaaaaccgttaatttacttaattatgcccaaaaaagaacttaaagataagaaggccaatgccgccgatctatctaccgctattctagaacaaaaggcaaagccaaatcgtcttattgttgatgatgtcgttgagaacaatgatgacaactcgattgtcactctttccgaaagtaaactcgaagaactcggtctttttagaggtgataccgtacttttaaaaggaaagaaaagaaaggagaccgtttgtatcgtgttaggcgacgaatcatgtccaaatgaaaagattcgcatgaacagatctattcgtaagaatttaagaattagattaggtgatatagtcagtattcaacaatgtgatgatgctaaatacggtaaaagaatacatgttctaccaatcgatgataccgtcgaaggattgactggaagtctattcgatgtctatttaaaaccatactttaccgaagcatatagacctgtacataaaggcgatcttttcctcgtca

SEQ ID NO: 49778 - protein, 160 aa, Panicum virgatum
  misc_feature: Ceres CLONE 2052170
  misc_feature (26)..(114): Pfam Name: CDC48_N Pfam Description: Cell division protein 48 (CDC48), N-terminal domain
MPKKELKDKKANAADLSTAILEQKAKPNRLIVDDVVENNDDNSIVTLSESKLEELGLFRGDTVLLKGKKRKETVCIVLGDESCPNEKIRMNRSIRKNLRIRLGDIVSIQQCDDAKYGKRIHVLPIDDTVEGLTGSLFDVYLKPYFTEAYRPVHKGDLFLV

SEQ ID NO: 49779 - DNA, 662 bp, Panicum virgatum
  misc_feature: Ceres CLONE 2052176
  misc_feature: Encodes the peptide sequence at SEQ ID NO. 49780
attgccaatgaagtgaaatcttgcttccgtgttgggtggtctgatgaaggcagccctgaacgtggatttcagtacatttatctaactgaagaagactatgctcgtattagctcttctgttatagcacataagctgcagctggatagcggtgaaattaggtggattattgactctgttgtgggcaaggaggatgggcttggtgttgagaatatacatggaagtgctgctattgccagtgcttattctagggcatacgaggagacatttacacttacatttgtcactggacggactgtagggataggtgcttatcttgctcgtcttggtatacgttgcatacaacgtcttgaccagcctattattttaactgggttttctgccctgaacaagcttcttgggcgggaagtgtacagctctcacatgcagttgggtggtcctaagatcatggcaaccaatggtgttgtccacttgactgtttctgatgaccttgaaggtgtttacaatatattgaggtggctcagctatgttcctgccaacattggtggacctcttcctattacaaaacctttggatccaccagatagacctgttgcatacatccctgagaacacatgtgatccgcgtgcggctattcgtggtattgatgacagccaagggaaatg

SEQ ID NO: 49780 - protein, 220 aa, Panicum virgatum
  misc_feature: Ceres CLONE 2052176
  misc_feature (1)..(220): Pfam Name: Carboxyl_trans Pfam Description: Carboxyl transferase domain
  misc_feature: Functional homolog of the protein sequence given in SEQ ID NO 51511
  misc_feature: Useful for making plants with altered oil content
  misc_feature: Useful for making plants with modulated herbicide sensitivity
IANEVKSCFRVGWSDEGSPERGFQYIYLTEEDYARISSSVIAHKLQLDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVSDDLEGVYNILRWLSYVPANIGGPLPITKPLDPPDRPVAYIPENTCDPRAAIRGIDDSQGK

SEQ ID NO: 49781 - DNA, 688 bp, Panicum virgatum
  misc_feature: Ceres CLONE 2052181
  misc_feature: Encodes the peptide sequence at SEQ ID NO. 49782
ataccctcctctccaactccctcttctctatctcccctctctcgctctctgcctcaccaacccctacctcccggggcgaattccgaggcggacgcaagaacagggaagtagccatagggaattgcctcatgaggtgatccggcacgcccacgaaccccgggctgggattctagttccaatcccctccgcgccggacgggcgcgccgccacccggatcaggcgtcctcgcgccatcgactccatctctcgccctcccgtcgccgtctccccgtggcggcggcctagcgaagatccgccggcgccttgggatcgtttgcttctcctttttgtcggtgaggaagcccctatctcgctcgaatcgatagttcgtttttcttccgtggaatttgaaatcttccttccgggaaggatgctccgacccgtccattttgttttggattcatgtgttgcgccgtggagtgcgaatagctggtaattttgctccacgtttggtgcgcagctggactccggtgctgtacatgcttgacgctggtgctgagcttttgcaatggcccgaaggaatgccggcgcaatgccgcgggaggggtcggcggggtcagttaaggactggtcggaattcgacccctcgccttcccccaagctggcgtactcgcagtcctacgtcgcgatgaggggcctgttgacgtcg

SEQ ID NO: 49782 - protein, 46 aa, Panicum virgatum
  misc_feature: Ceres CLONE 2052181
  misc_feature: Functional homolog of the protein sequence given in SEQ ID NO 51778
  misc_feature: Useful for making plants with altered carbohydrate content
MARRNAGAMPREGSAGSVKDWSEFDPSPSPKLAYSQSYVAMRGLLT

SEQ ID NO: 49783 - DNA, 530 bp, Panicum virgatum
  misc_feature: Ceres CLONE 2052276
  misc_feature: Encodes the peptide sequence at SEQ ID NO. 49784
aaagccccccgccgggtgggtaatataccatggccaccacccacgccctcgccgccgccaccacctccgcttgcgccgcgcttccccagcagtctctctctcgctcccgctctttgccatggcggcgtcgccgccgcggtttcctcccttcgccgcggcgctggcggcggtcgcggtgctggctgctgcgggctgggccgcggccggggacccgccgctctcgcccaaggggctcaactacgaaggtgcgcgcgcgcgcgtgcgcgtggggtggggttcaaaagtggcggcgctgatggcggtgaagagccggctgcgggacgagaagggggtcatggcgctgtgggacatcaactccgtcgacccctgcacctggtccatggtcgcctgctcccccgacaagttcgtcgtctcgctccagatggccaacaacggcttgtccgggacgctgtcgccgagcatcgggaacctcagccacctgcagacaatgtcactacaaaataacaaaatatcaggtgatattcctccaa

SEQ ID NO: 49784 - protein, 137 aa, Panicum virgatum
  misc_feature: Ceres CLONE 2052276
  misc_feature (52)..(92): Pfam Name: LRRNT_2 Pfam Description: Leucine rich repeat N-terminal domain
  misc_feature: SWISSPROT Homolog: EC 2.7.11.1 Non-specific serine/threonine protein kinase
MAASPPRFPPFAAALAAVAVLAAAGWAAAGDPPLSPKGLNYEGARARVRVGWGSKVAALMAVKSRLRDEKGVMALWDINSVDPCTWSMVACSPDKFVVSLQMANNGLSGTLSPSIGNLSHLQTMSLQNNKISGDIPP

SEQ ID NO: 49785 - DNA, 343 bp, Panicum virgatum
  misc_feature: Ceres CLONE 2052282
  misc_feature: Encodes the peptide sequence at SEQ ID NO. 49786
atcccatcgatcggaatcgaaaaaaaaaagctcacaccaaatcccccctccccctccgcccccgccgccgccatggcgacctcccgcacgtcctgggccgacgtcgccgacgccgagcccgcgccgcccccgaccgtcaccaccaccaccaccaccgcccccgcggcctccaacggccccgcccgctcctcctacgtcccgccccacctccgcaaccgctccgcctccgcctcctccgccgccgcggtcccgtcctccgccgcggcgccgccctcccgctccgccgccggcatcctctcccgccccggcggtggcggcggcggcgggggggggggggggggcg

SEQ ID NO: 49786 - protein, 113 aa, Panicum virgatum
  misc_feature: Ceres CLONE 2052282
  misc_feature: Functional homolog of the protein sequence given in SEQ ID NO 50205
  misc_feature: Useful for making plants with altered cell wall content and/or composition
SHRSESKKKSSHQIPPPPPPPPPPWRPPARPGPTSPTPSPRRPRPSPPPPPPPPRPPTAPPAPPTSRPTSATAPPPPPPPPRSRPPPRRRPPAPPPASSPAPAVAAAAGGGGG

SEQ ID NO: 49787 - DNA, 717 bp, Panicum virgatum
  misc_feature: Ceres CLONE 2052285
  misc_feature: Encodes the peptide sequence at SEQ ID NO. 49788
actgacgagtgacggcaccccttccctctccctagcttcgccattgccggccacccctgtccacagccgccgtgacagctgtcggcctgtcgcggcgccatggcgcgctcccattcgtctccgaaggccgccgccctgctcctcctcctcctcctcctcctctgcgcgggcactgccaccctcccggcggcgcaggcacagccgctggcgtcgtcgcaggccaaggcgctcctccgcgtgcgccgcctgctgggctacccgccggcgctcgagccgctgcggcgcgcgccggacccctgcgcgctgccgccgtcgccgtccctcgccgtggcctgcgcgggggggcacgtcacggcgctctcggtccgcggcgaccgcgatccggccccggcgctcccgcccaccttctctgccgacgcgctcttcactacgctcgccaggctccccgcgctcgcgcgcctctcgctcgtcggcctcggcgcctggggccctctcccgggcgccaagctccgccgcctccaggcgctgcagcagctcaacctcagcgccaactacttcgacggcgccgtcccgagcgacctcgcccggctctactctctgcagagcctcgtcctgtcgcggaaccggctcaacggctccgtgccgtccctcgccgggctccagttcctcgaggagctcgacctctcgcgcaaccgcctcgggccggcgttcccggag

SEQ ID NO: 49788 - protein, 205 aa, Panicum virgatum
  misc_feature: Ceres CLONE 2052285
  misc_feature: SWISSPROT Homolog: EC 2.7.11.1 Non-specific serine/threonine protein kinase
MARSHSSPKAAALLLLLLLLLCAGTATLPAAQAQPLASSQAKALLRVRRLLGYPPALEPLRRAPDPCALPPSPSLAVACAGGHVTALSVRGDRDPAPALPPTFSADALFTTLARLPALARLSLVGLGAWGPLPGAKLRRLQALQQLNLSANYFDGAVPSDLARLYSLQSLVLSRNRLNGSVPSLAGLQFLEELDLSRNRLGPAFP

SEQ ID NO: 49789 - DNA, 684 bp, Panicum virgatum
  misc_feature: Ceres CLONE 2052290
  misc_feature: Encodes the peptide sequence at SEQ ID NO. 49790
acccggcggcaggcgcccaagaactcactctcaccagtgccactgcgacagtgacagtccccgctccctctctcccggccatggcgtccaggcgctcgctcccccggctgctcatccacctcctgctcctgctcctctccgcggccgccgccgcggaggcgtcgtccccgcgcagcgcggaggtggacgcgctcatggagctcaaggcggcgctggacccctcgggccgcgcgctcgcctcgtgggcgggcggcggcgacccctgcggccgcggggactacttcgagggcgtctcctgcgacgcgcgcggcagggtcgccgccatcgcgctgcaggggaaggggctcgccggcaccgtcccgcccgcgctcgccctgctcccgggcctcaccggcctctacctccactacaacgacctccgcggggacatcccgcgggagctcgccggcctcccggacctcgctgagctctacctcggcgtcaacaacctgtccggcgccatccccgccgagctcggccggctccgcagcctccaagtactgcagctcggctacaatcagttgtcagggagcatcccaactcagctgggtcagctaaagaagctcactgttcttgcccttcagtccaaccagctcactggcgcaatacccgcatccctcggggacttgccggcactgacacggc

SEQ ID NO: 49790 - protein, 201 aa, Panicum virgatum
  misc_feature: Ceres CLONE 2052290
  misc_feature (31)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MASRRSLPRLLIHLLLLLLSAAAAAEASSPRSAEVDALMELKAALDPSGRALASWAGGGDPCGRGDYFEGVSCDARGRVAAIALQGKGLAGTVPPALALLPGLTGLYLHYNDLRGDIPRELAGLPDLAELYLGVNNLSGAIPAELGRLRSLQVLQLGYNQLSGSIPTQLGQLKKLTVLALQSNQLTGAIPASLGDLPALTR

SEQ ID NO: 49791 - DNA, 588 bp, Panicum virgatum
  misc_feature: Ceres CLONE 2052316
  misc_feature: Encodes the peptide sequence at SEQ ID NO. 49792
gcaggcagtagtaggccgcttccaatcccccccacccagcgcaatcgggattccctgacttgctgaagcggccctcttcagctgctctgctctgctctgcccctgctgccgagtgccgaggtggattaatgtccagcgccgctgccgacccggaggagatcagggcgcgcgtcgtcgtcctcggcgcgcaccatgccgccgacgagtgggcgcgcccggagctcgaggccttccacctgccctccccatcccaatctggcttgctagcacagcaaggagaagcagcagagcaatcccaatccacaccccctgctgctgctcctcctccgcctcctctggagatcgagcagccttccaatgccaggccatccagtaacatcgacgccgccatgatgaacaaggaggagaagaagaagcaacccaccccgccggccgccctgcgcgacctcttccgcttcgccgacggcctcgactgcgtgctcatgctcgtcggcaccctgggcgcgctcgtccacggctgctcgctccccgtgttcctccgcttcttcgccgacctcgtcgactcgttcggctcccacgccgacgacc

SEQ ID NO: 49792 - protein, 66 aa, Panicum virgatum
  misc_feature: Ceres CLONE 2052316
  misc_feature: SWISSPROT Homolog: EC 3.6.3.44 Xenobiotic-transporting ATPase
  misc_feature: The sequence is a functional homolog of SEQ ID NO 3 in US patent 7041874
MMNKEEKKKQPTPPAALRDLFRFADGLDCVLMLVGTLGALVHGCSLPVFLRFFADLVDSFGSHADD

SEQ ID NO: 49793 - DNA, 660 bp, Panicum virgatum
  misc_feature: Ceres CLONE 2052340
  misc_feature: Encodes the peptide sequence at SEQ ID NO. 49794
atcacactcatcgctggagcgcaggaggagcttgtttgtttccgcaaacctgcgtacacacgcagtataatccagctgctatcagctcattgcaagcttagcggcggcagtgtagcagaggaagcaagggaaagcagagcaggagagccgatagagatagctccgtgctgctgccggtcgtctcgtcctcgatagagaattagagatagcagcaggttaaggacccggccggtcgagctgatcggatcgtcatcggagggagggagagggaggatggtgaacacggcggcgagcctgggcagcggcagggcgggcggcgtgctgccgctggcgtcgctgaaccacatcagcatcgtgtgccggtcggtggaggagtcgctgcgcttctacaccgacgtgctgggcttcgcccccatccgccgcccgggctccttcgacttcgacggcgcatggctgttcaactacgggatcggcatccacctgctgcagtcggaggaccccggcagcctgccggagaagagggagatcaaccccaaggacaaccacatctccttccaggtactcaccaccgtctctctctctcgctctgtctcgctcaccatcactagtgactcgtaccagaatttaatatctattttttctccctgatccgccgacggc

SEQ ID NO: 49794 - protein, 124 aa, Panicum virgatum
  misc_feature: Ceres CLONE 2052340
  misc_feature: SWISSPROT Homolog: EC 5.1.99.1 Methylmalonyl-CoA epimerase
MVNTAASLGSGRAGGVLPLASLNHISIVCRSVEESLRFYTDVLGFAPIRRPGSFDFDGAWLFNYGIGIHLLQSEDPGSLPEKREINPKDNHISFQVLTTVSLSRSVSLTITSDSYQNLISIFSP

SEQ ID NO: 49795 - DNA, 582 bp, Panicum virgatum
  misc_feature: Ceres CLONE 2052341
  misc_feature: Encodes the peptide sequence at SEQ ID NO. 49796
actctctctctctctccctctctcccctctaccccttttcctctaacctttagctttcctccctccttccctctcctctcctctcttcttcccttcctctaacaagaactagtcctagccattcagatcctaagttgctggccttgctgcttcttgttggagaaagatttgttggttccaagttggaagtatcatgagtccaccgagtgtgatggggcagtttggagacacaacctacaccaaggttttcgttgggggactcgcatgggaaacccagaaggagaccatgaggaagtacttcgagcagtttggggagatcctggaggccgttgtcatcactgacaagaataccggcagatccaagggctacggatttgttaccttccgggaccccgatgcagcgatgagagcttgcgttgatcctgcgcctgtgattgacgggaggagggccaactgtaatctggcctcacttggggttcaaagatctaggcctccaacaccccagcacggaggatctaggagcttcagagtgatgaaatccttcagccagcaggcagggatccaaggtggactgggcacagc

SEQ ID NO: 49796 - protein, 123 aa, Panicum virgatum
  misc_feature: Ceres CLONE 2052341
  misc_feature (12)..(82): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50671
  misc_feature: Useful for making plants with modulated biomass
MGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGSRSFRVMKSFSQQAGIQGGLGT

SEQ ID NO: 49797 - DNA, 700 bp, Panicum virgatum
  misc_feature: Ceres CLONE 2052373
  misc_feature: Encodes the peptide sequence at SEQ ID NO. 49798
aaacgaatctcgtcttgcctcgctgctcgcctagccgcgtgcgtgcgactgtgagccgtgaggagcgccgccgccgccgccgcgcctctcctcgtcaccgccggcgcccctcttctcgtcccggccgctgcactcgcaggtgccggtatcgcatatcttcccgtcacctgcgccgccgcctgctgccctgcctccgcctccgccgtcaaaccctaagcgggccgtcgacttcacccgcgaggtgctaccaattttgaaagatggtggatgacgaacaggcaccaagttctaggaagagggttgctggtacccaaatcaacaaggataatcctgagcctgatgatgacggaccagagcaagagatgggtacatttaagaaagctcccgaggaagtgatggcaacccaaagaattgtaaaggttcggcgccagcagccgtcctcagctccttcttctaatcctttctctgcaatcagatttacccccacggattctagtgttcaagcaagtgcccctgtcacagaacctcaaccttcagaagtcaaagctgatgagggcagcaacagtagtgctaaagaaactttgcctatatcggacaagaatgctagctctggtgaggtaactgagattcagaaggatgaatcagctgtgaaaactgactctggtgccacaactgatgcgccgcctcaacctgttgaaac

SEQ ID NO: 49798 - protein, 146 aa, Panicum virgatum
  misc_feature: Ceres CLONE 2052373
  misc_feature (10)..(146): Pfam Name: NUP50 Pfam Description: NUP50 (Nucleoporin 50 kDa)
MVDDEQAPSSRKRVAGTQINKDNPEPDDDGPEQEMGTFKKAPEEVMATQRIVKVRRQQPSSAPSSNPFSAIRFTPTDSSVQASAPVTEPQPSEVKADEGSNSSAKETLPISDKNASSGEVTEIQKDESAVKTDSGATTDAPPQPVE

SEQ ID NO: 49799 - DNA, 670 bp, Panicum virgatum
  misc_feature: Ceres CLONE 2052384
  misc_feature: Encodes the peptide sequence at SEQ ID NO. 49800
ggaaagccaacgcacttttcgctcgcctcagtccgctgcctcgctttgcggtgctccaccctgcccttgtcttttccccgcctccgcctccgtctgcccggcccgctactggcccctctaaacctcccccgcatccacccacccccacccacccggcgatgccctcgcggcagcccccgccgccggctccgtcgccgaccccggccgcgggggcggcggtcgtcctcgcggaccttcgatcccgcggggggcgccaccgccaccgcgtatccgctgcccccgccgccgctgcgggggcctcggccgcggcggccctgatcttagcggtcgccgtcgcgctgctactgatgtggcgcaggcggaggcggcggaagctggccgcggcggcaggggcgcatccgggggccgagctgcggaggctgtcgtaccagcatctgcgccgcgccacgggcggcttcgcggcggggagcaagctgggtcagggcgggttcggcccggtcttccgcggcgcgctgccccggtcgggccagcccgtggccgtcaaggtcatggacgccgcggggtccctccagggcgagcgcgagttccacaacgaggtctccctggcctcccacctcctcggctgcgccgccccggccccgggggcgccgccatccatcctcctcccgtt

SEQ ID NO: 49800 - protein, 170 aa, Panicum virgatum
  misc_feature: Ceres CLONE 2052384
  misc_feature: SWISSPROT Homolog: EC 2.7.11.1 Non-specific serine/threonine protein kinase
MPSRQPPPPAPSPTPAAGAAVVLADLRSRGGRHRHRVSAAPAAAAGASAAAALILAVAVALLLMWRRRRRRKLAAAAGAHPGAELRRLSYQHLRRATGGFAAGSKLGQGGFGPVFRGALPRSGQPVAVKVMDAAGSLQGEREFHNEVSLASHLLGCAAPAPGAPPSILLP

SEQ ID NO: 49801 - DNA, 681 bp, Panicum virgatum
  misc_feature: Ceres CLONE 2052392
  misc_feature: Encodes the peptide sequence at SEQ ID NO. 49802
ctctccactcttcagctctctcttccccttccatcactcacacccaccacctactcccccagagcccgccatggcagcaccctcgggagcttgcggctccagctccccttcttcctcgtgctagtgttcttagccgttgacgatggcggcggtggcgagcagggagaggctctccccgggcgccgcgccgcaggtggacacgggcaagtacgtgcggtacacaccggagcaggtggaggcgctggagcgcgtctacagcgagtgccccaagcccagctcgctgcgtcggcagcagctcatcagggactgccccatcctcagcaacatcgagcccaagcagatcaaggtctggttccagaaccgcagatgccgggagaagcagcgcaaggaggcctctcgcctgcaaactgtgaatcggaagctgagtgcaatgaataagctgttgatggaggagaatgaccggctgcagaaacaggtgtcccgtctggtctatgacaacgggtacatgaagaatcaacttcacagtccttctgtagccaccacagacacaagctgtgagtctgtggtgacaagtagtcagcactaccaacagcaaaacccagcagttccgcctcctcctcaaagggatgcgaacaacccagcaggtctactcgctatcgctgaggagaccttggcagagtt

SEQ ID NO: 49802 - protein, 179 aa, Panicum virgatum
  misc_feature: Ceres CLONE 2052392
  misc_feature (22)..(80): Pfam Name: Homeobox Pfam Description: Homeobox domain
  misc_feature: Functional homolog of the protein sequence given in SEQ ID NO 50330
  misc_feature: Useful for making plants with altered carbohydrate content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
MAAVASRERLSPGAAPQVDTGKYVRYTPEQVEALERVYSECPKPSSLRRQQLIRDCPILSNIEPKQIKVWFQNRRCREKQRKEASRLQTVNRKLSAMNKLLMEENDRLQKQVSRLVYDNGYMKNQLHSPSVATTDTSCESVVTSSQHYQQQNPAVPPPPQRDANNPAGLLAIAEETLAE

SEQ ID NO: 49803 - DNA, 593 bp, Panicum virgatum
  misc_feature: Ceres CLONE 2052401
  misc_feature: Encodes the peptide sequence at SEQ ID NO. 49804
tcggctcgattcctcgccattggtgaaagctcagcggcggcgtccatcgtcgggcttcggagctcctgccggccatggacatggatatacaactcggggactattctccggacaagtttgccagcatcgctctttcacccaaagggcgcacggactcgcaggaaggccgctggagggcgcaggagaagtcgatcgacgactggctgccgatcaacgccaggaggaacgccaagtggtggtactccgccttccacaatgtcaccgccatggtcggcgccggcgtgctaagccttccctacgccatgtccgagctcggctggggagccggcgtcacggtgctgatcctgtcgtggatcatcacgctgtacacgctgtggcagatggtggagatgcacgagatggtgccgggcaagcggttcgaccggtaccacgagctgggacagcacgcgttcggcgagaagctgggcctctggatcgtcgtgccgcagcagctggtggtggaggtcggcctgaacatcgtctacatggtcaccggcggccagtccctgcagaagttccacgacgtcgtctgccacgacaggtgcaagcacatc

SEQ ID NO: 49804 - protein, 172 aa, Panicum virgatum
  misc_feature: Ceres CLONE 2052401
  misc_feature: Functional homolog of the protein sequence given in SEQ ID NO 50668
  misc_feature: Useful for making plants with altered oil content
MDMDIQLGDYSPDKFASIALSPKGRTDSQEGRWRAQEKSIDDWLPINARRNAKWWYSAFHNVTAMVGAGVLSLPYAMSELGWGAGVTVLILSWIITLYTLWQMVEMHEMVPGKRFDRYHELGQHAFGEKLGLWIVVPQQLVVEVGLNIVYMVTGGQSLQKFHDVVCHDRCKH

SEQ ID NO: 49805 - DNA, 761 bp, Panicum virgatum
  misc_feature: Ceres CLONE 2052421
  misc_feature: Encodes the peptide sequence at SEQ ID NO. 49806
  misc_feature (690)..(690): n is a, c, t, g, unknown, or other
actcggtgctcggagctcaccgaatccaccccttcccatccccactactactaggactcccccctcccccttcccccctcgctccgtccccagagcttccccattgccaccgccggcctgtcccctcctcctcccttcagttccttcatcagagactagttcaatcaaggaggaggagcacaccatacgccgccattactccctccctcctgcttgcgcctttgacccgccctccgtcgaatgatcaaccactgaccgatccgtagctccacgccatggcctccaacggcggcggcctccgccacagcaacagcagccgcctctcgcgcatgtcctactccggcgaggacggccgcggcgcccaggcccccgccgccgaccgccccatggtcaccttcgcccgccgcacccactccggccgctacgtcagctactcccgcgacgacctcgacagcgagctcggcggcagccccgacttctcgcccgaccaccaggagttccacagctaccacgtccacatcccggccacgcccgacaaccagcccatggaccccgccatctccgcccgtgtcgaggagcagtacgtctctaactcgctcttcaccggcggcttcaacagcgtcacgcgcgcccacctcatggacaaggtcatcgagtccgaggccagccacccgcagatggccggcgccnagggatcctcctgcgcccatcacggatgcgacgcccaggtcatgagcgacgagcgcggcgaggacatcctc

SEQ ID NO: 49806 - protein, 161 aa, Panicum virgatum
  misc_feature: Ceres CLONE 2052421
  misc_feature: Functional homolog of the protein sequence given in SEQ ID NO 50176
  misc_feature: Useful for making plants with altered cell wall content and/or composition
  misc_feature (139)..(139): Xaa is any aa, unknown, or other
MASNGGGLRHSNSSRLSRMSYSGEDGRGAQAPAADRPMVTFARRTHSGRYVSYSRDDLDSELGGSPDFSPDHQEFHSYHVHIPATPDNQPMDPAISARVEEQYVSNSLFTGGFNSVTRAHLMDKVIESEASHPQMAGAXGSSCAHHGCDAQVMSDERGEDI

SEQ ID NO: 49807 - DNA, 537 bp, Panicum virgatum
  misc_feature: Ceres CLONE 2052429
  misc_feature: Encodes the peptide sequence at SEQ ID NO. 49808
actcttcttctgctgctctgctcttgctctgcactcggcacaccaacgtcgtttccaatcctcgctccattgtccactccactctcgataatcaccagctgttatctcaagcatcacccgcggggggagatgatgtgtgcttcgtcttccccgggaaatcggcgcggtcttcttcctcccctcgcgctgctgctgatcgccggcgctctgcagcagcacccggcctcggctgagaaaaagccgtacgtcgtctacctcggcgagcactcgcacggccgggcgggcgcggcggcggcgtcgagccgggcgcgcgccaggaggtcccacgtcgagctcctgggcgccgtcctgcgcagcgaggccagggcgaggggcgccatcttctactcctacacccgctacatcaacggcttcgccgccacgctggacgagggcgaggcggcggagctctccaggcacccgcgcgtggtgtccgtgttcccgaaccgggggcaccggctgcacacgacgcggtcgtgggagttcctggggatggag

SEQ ID NO: 49808 - protein, 135 aa, Panicum virgatum
  misc_feature: Ceres CLONE 2052429
  misc_feature (37)..(125): Pfam Name: Subtilisin_N Pfam Description: Subtilisin N-terminal Region
  misc_feature: SWISSPROT Homolog: EC 3.4.21.25 Cucumisin
MMCASSSPGNRRGLLPPLALLLIAGALQQHPASAEKKPYVVYLGEHSHGRAGAAAASSRARARRSHVELLGAVLRSEARARGAIFYSYTRYINGFAATLDEGEAAELSRHPRVVSVFPNRGHRLHTTRSWEFLGM

SEQ ID NO: 49809 - DNA, 706 bp, Panicum virgatum
  misc_feature: Ceres CLONE 2052437
  misc_feature: Encodes the peptide sequence at SEQ ID NO. 49810
agcggcagcgcgtgtgtgcgcgtaatccctgtcgctgtcgcccccgcctgccctcggagcagagagaggcgcggcaccacgcacccacgcccacgcccaccacctccacctccgcgggcgagaacccgagaggctccaaatcctaaccaccgcggggcggcctcatcctcccgctcccaccacccgtccggccgccggatcgctgcggcggcgccggcgcgcggatccaatgcggctgctgctgctgcggtagctgcgggaggcggctgcggcgctggttcctagttgatgcggcggacgatctgaggaggaggggatggcggcgtcggcatcggcatcggcgccggggtcggcggagcggcaggctcgcggcggcgcggcgttggcgagcggcaacgcggtatttaagagtggccctctcttcatatcatccaaaggaattggatggaaatcatggaaaaaacgttggttcatcctcacaagaacatcgctggttttcttcaagagtgatcctagtacattgcctcagcgaagtggtgaagtgaaccttacattggggggaattgacctgaataattctggaagtgtggtagtcagggaagacaaaaagttgctgactgtcctttttccagatggccgtgatggccgtgccttcaccttgaaggcagaaacttctgaagacttattcgagtggaaagcagcactg

SEQ ID NO: 49810 - protein, 129 aa, Panicum virgatum
  misc_feature: Ceres CLONE 2052437
  misc_feature (29)..(128): Pfam Name: PH Pfam Description: PH domain
  misc_feature: SWISSPROT Homolog: EC 3.6.5.5 Dynamin GTPase
MAASASASAPGSAERQARGGAALASGNAVFKSGPLFISSKGIGWKSWKKRWFILTRTSLVFFKSDPSTLPQRSGEVNLTLGGIDLNNSGSVVVREDKKLLTVLFPDGRDGRAFTLKAETSEDLFEWKAA

SEQ ID NO: 49811 - DNA, 686 bp, Panicum virgatum
  misc_feature: Ceres CLONE 2052473
  misc_feature: Encodes the peptide sequence at SEQ ID NO. 49812
gtctgttcactcttccctctcggaatcccccgacccaaactaaccctagccgcgagttgctggcggcgtgaggcggcgacgcgccgacgcgcctgtccgaggacgtcacgcgcacggtcctacgccgctgctccgcatcgaaggccgtggctgggctcgcatcgcctggtctggatgatatccgcggcgtggagagagagcgccagcgagggatcccagtgcgggtggctttcggaggccggctcgcggggctgaggcggcctggcgggcttgcttgcggttgggggccggcatccggcggcggctgtgccctaacacgcacggaaccatctcaggtatgtatttctcaccactttcagagaatttgcaagctagatgtcaacatgtaaatcatttttgacatttttttttaaaaaaaatttggaacatctaacagtaattaaacatgtcagctcacacccacacacttgaagagttatcagagtatgaatatatcatacagaagaacttcagttcggaggatgaggggtatgagtttttcaatgcttttgctaggaataaggggtttagtttaaggaagggaaaagtccatcgtgcagcaaacaaagttgatacaatttggcgacagtatgtctgctcaaaagaaggggtcaggcaacctagcaagttgttgaatataaaaaaat

SEQ ID NO: 49812 - protein, 80 aa, Panicum virgatum
  misc_feature: Ceres CLONE 2052473
  misc_feature (30)..(80): Pfam Name: FAR1 Pfam Description: FAR1 family
MSAHTHTLEELSEYEYIIQKNFSSEDEGYEFFNAFARNKGFSLRKGKVHRAANKVDTIWRQYVCSKEGVRQPSKLLNIKK

SEQ ID NO: 49813 - DNA, 731 bp, Panicum virgatum
  misc_feature: Ceres CLONE 2052483
  misc_feature: Encodes the peptide sequence at SEQ ID NO. 49814
tatccgatctgccacctccacgccgtctcgcacgttccttccccaacttccgcagcgcaggcggctccccgcgccgcgatccagatccaggttcttcagcatgggtctggtgaaggatagcgccgacatggaggagggaaccctcgagatcggcatggagtacaggacggtctctggtgtggccggacctctggttatattggacaaagtaaagggcccaaagtaccaggaaatcgtgaacatccgactcggagatggcacaactcgccgtggtcaagttttggaagttgacggtgaaaaagctgttgtgcaggtctttgaaggaacttccggaatagacaacaaatacacaactgtgcagttcacaggcgaggtatcttgtcaaatttgcagtttatgtactgataaagtgtttagcaggcaaaactctttgaattaggtagtttggatttggtgatctagctcataaacaaaatgcacatattattgatatctatatctagtttaaccatgaagctatttatagtcatgttaattgaggaaggacaattggataacattggaagaatgaagtgtacatgatcttccagattgaaatttaacagtgacatcgttttctttctccttgtttgtatatatatcgagaagttgccaccttgtttgcttagtgactatatgttactttttctcacaggttctgaaaactcctgtatcacttgatatgcttgggc

SEQ ID NO: 49814 - protein, 112 aa, Panicum virgatum
  misc_feature: Ceres CLONE 2052483
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKDSADMEEGTLEIGMEYRTVSGVAGPLVILDKVKGPKYQEIVNIRLGDGTTRRGQVLEVDGEKAVVQVFEGTSGIDNKYTTVQFTGEVSCQICSLCTDKVFSRQNSLN

SEQ ID NO: 49815 - DNA, 687 bp, Panicum virgatum
  misc_feature: Ceres CLONE 2052485
  misc_feature: Encodes the peptide sequence at SEQ ID NO. 49816
atccgccgggtcgcctcgagccgcagcccgtcggtgcccaatctcgatccggtggttccctaggctcgggtttcggaagggattgctcgcgattagcgattccgttgatcgtttcgttggttccgtggttgttaatttgattccttgctgtagacttgtagcggaagccatggcgtcgtcggcgctaatctgcgacacggagcagtggaaggcccttcaggcgcacgtcggcgcgattcagaagacgcacctgcgggacctgatggccgacgccgaccgctgcaaggcaatgacggctgagtttgaagggatttttctggattactcgaggcagcaggcgacacgtgaaaccattgagaagctgctcaaattggcagaggctgcgaagctcaaggagaagattgagaagatgtttaaaggtgaaaagataaatagcacagaaaacaggtcagtgcttcatgtagctctaagggctccaagagatgcagtcataaacagtgatggggtaaatgtggtccctgaggtttggagtgttaaagataaaatcaagcagttttcagagacttttagaagtggatcatgggttggggcaactggaaaagcattgacaaatgttgtgtcagttggaataggtggtagcttttcttgggcctctatttgtgcatactgcactccaaactgatccag

SEQ ID NO: 49816 - protein, 170 aa, Panicum virgatum
  misc_feature: Ceres CLONE 2052485
  misc_feature: SWISSPROT Homolog: EC 5.3.1.9 Glucose-6-phosphate isomerase
  misc_feature: Functional homolog of the protein sequence given in SEQ ID NO 50766
  misc_feature: Useful for making plants with altered cell wall content and/or composition
MASSALICDTEQWKALQAHVGAIQKTHLRDLMADADRCKAMTAEFEGIFLDYSRQQATRETIEKLLKLAEAAKLKEKIEKMFKGEKINSTENRSVLHVALRAPRDAVINSDGVNVVPEVWSVKDKIKQFSETFRSGSWVGATGKALTNVVSVGIGGSFSWASICAYCTPN

SEQ ID NO: 49817 - DNA, 768 bp, Panicum virgatum
  misc_feature: Ceres CLONE 2052488
  misc_feature: Encodes the peptide sequence at SEQ ID NO. 49818
acccagtccagcacaagcaagcattcgctcctctcctctcctctgtacgggtgtatttcagcgtcagtgagtgcgagagtgctactggtatccggcgtgagttctgtacatgatcagtggtgagattgagaggcacagtacttccaacgtccgattcgggagcctccagcgcggcctcgagacgcttgcttgcatgcctgcccgggggaaggaagagatggcctcgccgcattattccggcagcactgctggtggggttgactcagaccagcttttggtagaagcaaatggctctacccggacactaattttgaacaggccaaagcagcttaatgcactttcctccacaatgattaaggaactcctgaggtgtttcattgcttaccaaaaagacgatggagttaaactgttgattatgaaggtatctcctttgaggtagtctaacttagattttagatgtcttttagtgttgaagtataagtgaataggctactccccacccccacccccacccacccaaaaaaaatcgtagacttttggtttgaattagttgttgcataaactcaaataattagagagacagagttccaacagaattaaccaagtagcaaggtagtgatggggaacatgagttacccaagcatctcccatagcaattatttactcttatctaattttaaccgtgtgatttgtattgaacttatatgaggtactaaataatgcctgttgccatgctaaggtctgcaaaaaggaagggagcggtattta

SEQ ID NO: 49818 - protein, 109 aa, Panicum virgatum
  misc_feature: Ceres CLONE 2052488
  misc_feature: SWISSPROT Homolog: EC 3.1.2.4 3-hydroxyisobutyryl-CoA hydrolase
MISGEIERHSTSNVRFGSLQRGLETLACMPARGKEEMASPHYSGSTAGGVDSDQLLVEANGSTRTLILNRPKQLNALSSTMIKELLRCFIAYQKDDGVKLLIMKVSPLR

SEQ ID NO: 49819 - DNA, 683 bp, Panicum virgatum
  misc_feature: Ceres CLONE 2052492
  misc_feature: Encodes the peptide sequence at SEQ ID NO. 49820
aagttcggcgcggaagaaggatcctctttcctggcgttcattgatggaaaattaatggcactgccacctcgctccgttcagagtttagtggttgggacttgggaggggcagagacctgcaagtcttttcccgtcctctgccctcaccagagccgccgccgccgctgaatttcctcctccatttactccctttgaaacactcctcgcgggcaccgggcaggagtggcaacccaaggagccggcaacccgaaggagagcattcgcgttctcgttctcatggatctttaggtctgcaggaaaaagaaggtcagtgttatgtgtgaaggctaggttctcgccgagcaatggatcttgagttcgggaggaggctgagatccccaaagagggactcttggaagaccaccttgctgctggcgtaccagagcttgggagtggtctatggagacctgagcatatctcctctgtacgtgtacaagagcaccttcgctgaggacatccagcactcggagacgaacgaggagatcttcggcgtgctctctttcgtgttctggaccctcaccttgatacctctcatcaagtacgtttcgattgtcctgcgagctgacgacaatggagagggaggaacatttgccctgtactctctgatttgcaggcacgcaaatgtgagccttctcccgaatcgcc

SEQ ID NO: 49820 - protein, 113 aa, Panicum virgatum
  misc_feature: Ceres CLONE 2052492
  misc_feature: Functional homolog of the protein sequence given in SEQ ID NO 50430
  misc_feature: Useful for making plants with modulated biomass
MDLEFGRRLRSPKRDSWKTTLLLAYQSLGVVYGDLSISPLYVYKSTFAEDIQHSETNEEIFGVLSFVFWTLTLIPLIKYVSIVLRADDNGEGGTFALYSLICRHANVSLLPNR

SEQ ID NO: 49821 - DNA, 705 bp, Panicum virgatum
  misc_feature: Ceres CLONE 2052521
  misc_feature: Encodes the peptide sequence at SEQ ID NO. 49822
accccaggctcgagcaaagccaccgccgatccgctgctcctgacccttctccgtgggccgcgcaggcatgaggctcctcctcgtcgccgccctcctcctctgggcctccgcggcggcggcgtccaagccgcccctcgacaccctcggcatccccccgcaagatgaggcgtactacaggggcggggtgatcaagtgcagggatggatcgggcaagttctccagggaccagctcaacgacgacttctgcgactgccccgacggcaccgacgagcccggaacatccgcgtgccctgaaggcaagttctactgcaagaatgcaggccacactccaatcacgatcttctcatcacgagtgaatgacggcatttgtgattgctgtgacgggagcgacgaatatgatagcaatgtcacctgtaagaacacttgctgggaggctggcaaggcggcaagagataaattgaagaagaaaatcgctacgtacaaaagcggtgtcgttattcgaagacaggaagttgaaagggcaaaagaggcttttgctaaagatgaagcggagttagcaaaattgaagggtgaagagaagtaccctgacagaatccccgtcattgttgagaaggccgagagaagcgatatccccgacattgacaagaaaaagtaccttgttcctgccgacctcacagttggacagtttgtctatgtgggacggaa

SEQ ID NO: 49822 - protein, 212 aa, Panicum virgatum
  misc_feature: Ceres CLONE 2052521
  misc_feature (158)..(211): Pfam Name: MAP1_LC3 Pfam Description: Microtubule associated protein 1A/1B, light chain 3
MRLLLVAALLLWASAAAASKPPLDTLGIPPQDEAYYRGGVIKCRDGSGKFSRDQLNDDFCDCPDGTDEPGTSACPEGKFYCKNAGHTPITIFSSRVNDGICDCCDGSDEYDSNVTCKNTCWEAGKAARDKLKKKIATYKSGVVIRRQEVERAKEAFAKDEAELAKLKGEEKYPDRIPVIVEKAERSDIPDIDKKKYLVPADLTVGQFVYVGR

SEQ ID NO: 49823 - DNA, 161 bp, Panicum virgatum
  misc_feature: Ceres CLONE 2052570
  misc_feature: Encodes the peptide sequence at SEQ ID NO. 49824
ggaaccgagcggccctcccgtctcccaccacgatggccgccgcttctcacctcgccgtgctctccgtgctcgccctcctcgccgtggccgccacggcgcaggcgccctgcggcgcccccgccgcggcgccccaggcggccccgccgagcccggccactccg

SEQ ID NO: 49824 - protein, 42 aa, Panicum virgatum
  misc_feature: Ceres CLONE 2052570
  misc_feature: Functional homolog of the protein sequence given in SEQ ID NO 50389
  misc_feature: Useful for making plants with altered carbohydrate content
  misc_feature: Functional homolog of the protein sequence given in SEQ ID NO 50194
  misc_feature: Useful for making plants with altered cell wall content and/or composition
MAAASHLAVLSVLALLAVAATAQAPCGAPAAAPQAAPPSPAT

SEQ ID NO: 49825 - DNA, 769 bp, Panicum virgatum
  misc_feature: Ceres CLONE 2052571
  misc_feature: Encodes the peptide sequence at SEQ ID NO. 49826
aaaattagaatcgaaccctagttcgtcctcctccctcttcgattccccccgatccccagcaggcgaccgccggaaccctagctagccctagatacaccgcgccaccgccatggcgaccctcaaggatctcctcccggcgcccaagacgtcggcgtccaccttctacgaccacagcagcgacccctggttcaaggagcggtacggcggggactcggcgcaggcgtcggccgcggcgaggcccgcgggcgccgccagaaccatccctccgtacgggaagcgggcggggttcgtgccgcgccggccggaggactttggggatggcggcgccttcccggagatccatgtcgcgcagtatccactcggcatgggccgccgcgacgacaagggcgggtccaagatcctcgcgctcaccgtcgacgcgcacgggagcgtcgccttcgacgccgtcgtcaagcagggcgagaacgccggcaagatcgtctactccaagcacagcgacctcgtgccgaagatcgccacgtccgattcgcaggcgccggacgaggaggaggaggagcagaagcagatcgaggagaccacagagcggacgaaggctgccttggagaaggttgtcaacgtccgcctctcagctgctcagcccaagaatgtgccgacacatgattctgagtcccagtttatcaagtataagccgtctcagcaatcagcggccttcaattcaggtgccaaggagaggatcattcggatgtcggagaaggcggtggatcctctt

SEQ ID NO: 49826 - protein, 219 aa, Panicum virgatum
  misc_feature: Ceres CLONE 2052571
  misc_feature: Functional homolog of the protein sequence given in SEQ ID NO 51146
  misc_feature: Useful for making plants with modulated biomass
  misc_feature: Useful for making plants with modulated flowering time
MATLKDLLPAPKTSASTFYDHSSDPWFKERYGGDSAQASAAARPAGAARTIPPYGKRAGFVPRRPEDFGDGGAFPEIHVAQYPLGMGRRDDKGGSKILALTVDAHGSVAFDAVVKQGENAGKIVYSKHSDLVPKIATSDSQAPDEEEEEQKQIEETTERTKAALEKVVNVRLSAAQPKNVPTHDSESQFIKYKPSQQSAAFNSGAKERIIRMSEKAVDP

SEQ ID NO: 49827 - DNA, 695 bp, Panicum virgatum
  misc_feature: Ceres CLONE 2052589
  misc_feature: Encodes the peptide sequence at SEQ ID NO. 49828
atccagtccacgccctccgccaccagcgcagtagccagccgagccgcctcagcccccctcgccgggcgcgatggcggtcacgcgcgtcgcgggggccgccgcactcccggccgcgccgccctcctcccgccgccgccgggccgcgctcccctcctcctgccggcctctccccacctcccgcgcgtccaaggcgctgcacgccgccgccgccgcaggcgcggtcgacgaggagatcctcgccgcgtcgccttcctcagattctagcaagggagtggagaacctggtgatcattggttccggcccggccgggtacactgctgcaatttacgctgccagggcaaacctgaagcccgtcgtgttcgaaggttaccaggtgggtggtgtccctggtgggcagctgatgaccacgaccgaggtggagaatttccctggttttcaagaaggtataacgggacctgatctgatggacagaatgcgtaagcaagcggaacgctggggtgcggagcttcaccaagaggatgttgagtttgtgaatgtaaagagcagcccatttgttatccgtagcagcgatcgcgaggtgaaatgttatagtgtaatcattgcaactggagcaacagctaagcgcctccgtttgcctcgtgaagatgaattttggagtagaggtatcagcgcatgtgccatatgtgacggagcat

SEQ ID NO: 49828 - protein, 208 aa, Panicum virgatum
  misc_feature: Ceres CLONE 2052589
  misc_feature (70)..(206): Pfam Name: Pyr_redox_2 Pfam Description: Pyridine nucleotide-disulphide oxidoreductase
  misc_feature: SWISSPROT Homolog: EC 1.8.1.9 Thioredoxin-disulfide reductase
MAVTRVAGAAALPAAPPSSRRRRAALPSSCRPLPTSRASKALHAAAAAGAVDEEILAASPSSDSSKGVENLVIIGSGPAGYTAAIYAARANLKPVVFEGYQVGGVPGGQLMTTTEVENFPGFQEGITGPDLMDRMRKQAERWGAELHQEDVEFVNVKSSPFVIRSSDREVKCYSVIIATGATAKRLRLPREDEFWSRGISACAICDGA

SEQ ID NO: 49829 - DNA, 655 bp, Panicum virgatum
  misc_feature: Ceres CLONE 2052592
  misc_feature: Encodes the peptide sequence at SEQ ID NO. 49830
acggggacttgtgtggcccggtgacaccggtcacaccaggaggacggcgctacttcttgctgctcgtcgacgacctctcccgcttcatgtgggtgatgatcctcggcagcaagggagaggctgcggacgccatcaggcgtgctcaggctgctgcggaggcggagagcgtccgcaagttgcgcgtgctgcgcaccgacaacggcggcgagttcacggcggccgagttcgcggcgtactgcgcggatgagggcatccagcgccactactccgcgccgtacagcccgcagcagaacggcgtcgtcgagcggcgcaaccagacggttgtggggatggcccgggccctcctcaagcagagggggatgccggctgtcttctggggagaggcggtggtgacggccgtctacatcctcaaccgctcgcccaccaaggcactcgacggcatgacgccgtatgaggcttggcatgggcgcaagccggcggtctcccacctgcgggtcttcggctgcctcgcgttcgccaaggagcttggccacatcggcaagctcgacgacaggagcactccgagagtgttcatcggctacgcggagggttcgaaggcctaccgcattctcgacccggagacacagcgtgtgcgcacggcgcgcgacgttgtgtt

SEQ ID NO: 49830 - protein, 217 aa, Panicum virgatum
  misc_feature: Ceres CLONE 2052592
  misc_feature (1)..(154): Pfam Name: rve Pfam Description: Integrase core domain
  misc_feature: SWISSPROT Homolog: EC 2.7.7.49 RNA-directed DNA polymerase
  misc_feature: The sequence is a functional homolog of SEQ ID NO 1842 in the 10/374,780 US patent application
  misc_feature: The sequence is a functional homolog of SEQ ID NO 1038 in the 10/374,780 US patent application
  misc_feature: The sequence is a functional homolog of SEQ ID NO 848 in the 10/666,642 US patent application
  misc_feature: The sequence is a functional homolog of SEQ ID NO 1037 in the 10/374,780 US patent application
  misc_feature: The sequence is a functional homolog of SEQ ID NO 847 in the 10/666,642 US patent application
  misc_feature: The sequence is a functional homolog of SEQ ID NO 1035 in the 10/374,780 US patent application
  misc_feature: The sequence is a functional homolog of SEQ ID NO 1040 in the 10/374,780 US patent application
  misc_feature: The sequence is a functional homolog of SEQ ID NO 845 in the 10/666,642 US patent application
  misc_feature: The sequence is a functional homolog of SEQ ID NO 850 in the 10/666,642 US patent application
GDLCGPVTPVTPGGRRYFLLLVDDLSRFMWVMILGSKGEAADAIRRAQAAAEAESVRKLRVLRTDNGGEFTAAEFAAYCADEGIQRHYSAPYSPQQNGVVERRNQTVVGMARALLKQRGMPAVFWGEAVVTAVYILNRSPTKALDGMTPYEAWHGRKPAVSHLRVFGCLAFAKELGHIGKLDDRSTPRVFIGYAEGSKAYRILDPETQRVRTARDVV

SEQ ID NO: 49831 - DNA, 639 bp, Panicum virgatum
  misc_feature: Ceres CLONE 2052593
  misc_feature: Encodes the peptide sequence at SEQ ID NO. 49832
ctcctcctccattggactgctccccgtttgacccttggtaattgagtacaattgaagcatggcgtgccaagtgtgactgcctccacagacttcccgaaccacttggtgcctccttctcctctcatcccaatgatctgattgctctcttttccaggtgtgttaaccctcgcaaggcaatgctccaactccttcaactgcttgctgagtttgatgcgctatatgatagtgacaaggagaagtatgcaccctttgaagactttcttcgtgctgctcatgaaccaattgtgcttcccccctgcgttgctcttgctatcaggcctaggcctgctgtctgggactacattcaggtgaatgtaactgacttggctgtggaagacctgaatgtttctgaatacttggcattcagcgaacacctggtggatggacacaacaacagcgactttgtgcttgagcttgactttgagcccttaggtgcctcattccctcctccttccatgtcaacgaccattgcaaatggaatacacttccttagcaggcacctgtcttccaagttgtttcatgacgaggagagcttgtaccccctgctgaaatctctcacatcctataactacaccggcacgactatgatgttgagtgaca

SEQ ID NO: 49832 - protein, 154 aa, Panicum virgatum
  misc_feature: Ceres CLONE 2052593
  misc_feature: SWISSPROT Homolog: EC 2.4.1.13 Sucrose synthase
  misc_feature: Functional homolog of the protein sequence given in SEQ ID NO 51467
  misc_feature: Useful for making plants with altered carbohydrate content
  misc_feature: Functional homolog of the protein sequence given in SEQ ID NO 50270
  misc_feature: Useful for making plants with altered cell wall content and/or composition
  misc_feature: The sequence is a functional homolog of SEQ ID NO 2 in US patent 7091398
  misc_feature: The sequence is a functional homolog of SEQ ID NO 12 in US patent 7091398
MLQLLQLLAEFDALYDSDKEKYAPFEDFLRAAHEPIVLPPCVALAIRPRPAVWDYIQVNVTDLAVEDLNVSEYLAFSEHLVDGHNNSDFVLELDFEPLGASFPPPSMSTTIANGIHFLSRHLSSKLFHDEESLYPLLKSLTSYNYTGTTMMLSD

SEQ ID NO: 49833 - DNA, 470 bp, Panicum virgatum
  misc_feature: Ceres CLONE 2052605
  misc_feature: Encodes the peptide sequence at SEQ ID NO. 49834
gaactagtccactgctccatccggccaccaccgagctccgagcgaagtatccctgccaagtgccgctgcccccccgcgccacctccgcgcccgagggcatgtccgtcgcctcctcccaccacctacgcccggcgccggccggcgcggcgcggcgccctggctgcacggccgccgtggcgctccggcccggcggtgcctggcccccgtcgcgcggccgctgcgccagcgcgggggcggcgggcgctgggggcgaagcggcttcggcccccggcgccgccgcggtggcggcggtcgaccccgcagcggccgccgccgtggacagggtgctgcgccacaggatttgcgtgctcgtccgggacgaaagcttcctgatcaaccggattgccggagtgtaccccatgagatggcacaacatcgagttgcttctccggggggctcaaggaggacaatgcgcttatcactgtcggggc

SEQ ID NO: 49834 - protein, 123 aa, Panicum virgatum
  misc_feature: Ceres CLONE 2052605
  misc_feature: SWISSPROT Homolog: EC 2.2.1.6 Acetolactate synthase
MSVASSHHLRPAPAGAARRPGCTAAVALRPGGAWPPSRGRCASAGAAGAGGEAASAPGAAAVAAVDPAAAAAVDRVLRHRICVLVRDESFLINRIAGVYPMRWHNIELLLRGAQGGQCAYHCR

SEQ ID NO: 49835 - DNA, 662 bp, Panicum virgatum
  misc_feature: Ceres CLONE 2052637
  misc_feature: Encodes the peptide sequence at SEQ ID NO. 49836
agaaaccatagatccaggcaaagacacattggccgagggagcaagcgccgccgcgggctgttgggcgtagatcggagaggcgaatttcagaggggagagatggtcgtcaacaagcgtggccgccgccgttgagcagagcagcaggggggatctggccggctgctgtatccatcgatggcctcaccctcccagcgccgccgcccctgtgtccagcaccaatccgcatggccagatctcccaccggagctgttggagcgcatcgtcgccgtcctcgttccgctcgaccgcgtcgccgtccgcctcgtctgcgcctcgtggcgcgcgtgcgtgcgggcggcgttcccctccgacctcccgttcgaggccccgcgcctcctcctccgtcgcccgggtgccgccggcgggctggccttgttcagcctccaccaccgcaaggtcctaccgttcgcgctccccgcgagcgtcagcacccgacgctgctgcggccacaccggcggctggctcgccatggctctggacgccgaccgttcgctcgtcctctgcaacctcgtctcgggccgatccgtcgccgtgcccccgcctccggtgttcccggtgtccaaggtgatcctctccgggccgcccacctccccgggctgggtcgcggccgcgctaggccgggc

SEQ ID NO: 49836 - protein, 162 aa, Panicum virgatum
  misc_feature: Ceres CLONE 2052637
  misc_feature (16)..(63): Pfam Name: F-box Pfam Description: F-box domain
MASPSQRRRPCVQHQSAWPDLPPELLERIVAVLVPLDRVAVRLVCASWRACVRAAFPSDLPFEAPRLLLRRPGAAGGLALFSLHHRKVLPFALPASVSTRRCCGHTGGWLAMALDADRSLVLCNLVSGRSVAVPPPPVFPVSKVILSGPPTSPGWVAAALGR

SEQ ID NO: 49837 - DNA, 635 bp, Panicum virgatum
  misc_feature: Ceres CLONE 2052646
  misc_feature: Encodes the peptide sequence at SEQ ID NO. 49838
aaaaaaaaacccaacgcctcggctccaagccagccagccaaccaaccctcccctgctgccgagcgtaaatctgccgagctcggcatggggtgaccagatcggggcgcggctcggtgctctacggctgaattccgctcgaggaggggggtttgccttgcctagaagaggccgcggggatggcgaacgccggcgtggccgtcggctcagggggtattagccatgctttgttcagggaactctggcatgcttgtgctgggccgttggtcacggtgcctcgccaaggcgagctggtttactacttcccgcaaggtcatctggaacagcttgaagcatctacagatcagcaacttgaccagcacttacctttgtttaatctaccatccaagatcctgtgcaaggtggtaaatgtagaactcagagctgaaactgattccgatgaagtttatgctcaaattatgctgcaaccagaagcagatcaaagtgagcccaccagcccagctcctgagctaccagagccagaaaggtgcaatgtccattccttctgcaagactttgactgcttcagacacgagcacccatggtggtttctctgtcctcaggagacatgctgaagaatgtttgccccaattggatatg

SEQ ID NO: 49838 - protein, 152 aa, Panicum virgatum
  misc_feature: Ceres CLONE 2052646
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 100 in the 10/666,642 US patent application
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
MANAGVAVGSGGISHALFRELWHACAGPLVTVPRQGELVYYFPQGHLEQLEASTDQQLDQHLPLFNLPSKILCKVVNVELRAETDSDEVYAQIMLQPEADQSEPTSPAPELPEPERCNVHSFCKTLTASDTSTHGGFSVLRRHAEECLPQLD

SEQ ID NO: 49839 - DNA, 664 bp, Panicum virgatum
  misc_feature: Ceres CLONE 2052648
  misc_feature: Encodes the peptide sequence at SEQ ID NO. 49840
agtgtttttccctgtttctaggtattttgccccccttttccgagtagattcatgagtttgggttatggaataacagcggcgttttgaagctggggtgtttgttgaatggtgcaggtctggaggaaagaaggtcagtgttatgtgtgaaggctaggttctcgccgagcaatggatcttgagttcgggagggggctgagatcctcaaagagggactcttggaagaccaccttgctgctggcgtaccagagcttgggagtggtctatggagacctgagcatttctcctctgtacgtgtacaagagcaccttcgccgaggacatccagcactcggagacgaacgaggagatcttcggcgtcctctctttcgtgttctggacgctcaccttgatccctctcatcaagtacgtttcgattgtcctgcgagctgacgacaatggcgagggaggaacatttgccctatactctctgatttgcaggcacgcaaatgtgagccttctcccgaatcgccaaattgctgatgaggagctttccacttataaactggaatgccctcccgacataaccgacaagtcccgtatcaaggtgtggcttgagaagcacaggaagctgcgcattgctctgttgattatggttatgattggcacttgtatggttattggggacg

SEQ ID NO: 49840 - protein, 165 aa, Panicum virgatum
  misc_feature: Ceres CLONE 2052648
  misc_feature (22)..(165): Pfam Name: K_trans Pfam Description: K+ potassium transporter
  misc_feature: Functional homolog of the protein sequence given in SEQ ID NO 50430
  misc_feature: Useful for making plants with modulated biomass
MDLEFGRGLRSSKRDSWKTTLLLAYQSLGVVYGDLSISPLYVYKSTFAEDIQHSETNEEIFGVLSFVFWTLTLIPLIKYVSIVLRADDNGEGGTFALYSLICRHANVSLLPNRQIADEELSTYKLECPPDITDKSRIKVWLEKHRKLRIALLIMVMIGTCMVIGD

SEQ ID NO: 49841 - DNA, 706 bp, Panicum virgatum
  misc_feature: Ceres CLONE 2052679
  misc_feature: Encodes the peptide sequence at SEQ ID NO. 49842
  misc_feature (639)..(639): n is a, c, t, g, unknown, or other
aaatcgacccccctccatcttccccttcccccctctccccacccatcccgatcccctccccttcgctcgcggccgccgccaggcacgcccgcctccttccgcctcgaagcggctcgtcgcttctggtgctcgtgctgccctccgttcccccatctcctggtggggggaggcgtggatccggacttgaggggatgatttcttctcttgctcttgccggaagcatgtcggatgggggtatcgtggtagccatttgccaatacggtggagagttcacttctggccccaatggtaatttgatatataaaggaggagaagcgcatgctgttgatgtcactcgtgatatgtcacttgagagcttcaaggatgaggtgtccaaggtgttccatgttgatgtcactgacatgtcattcaagtacttccttccgaataataacagaactctcatcacaatatcatgtgatcgagatttgcaacggatggttgattttactactagtgctgcacaagtggatgttttcttgattagtagagtggaaaacaggtatgctttgttgcaccttatcattataattcatgttgaagagtcagcttcacgcatatgtttccatgatgcatgcttttcgcttgatggataatcangagtattgtaactcactctggagtgtctgcaactaaacctgggtctaatgcgcctggcgccaaaaag

SEQ ID NO: 49842 - protein, 137 aa, Panicum virgatum
  misc_feature: Ceres CLONE 2052679
  misc_feature (20)..(103): Pfam Name: PB1 Pfam Description: PB1 domain
MSDGGIVVAICQYGGEFTSGPNGNLIYKGGEAHAVDVTRDMSLESFKDEVSKVFHVDVTDMSFKYFLPNNNRTLITISCDRDLQRMVDFTTSAAQVDVFLISRVENRYALLHLIIIIHVEESASRICFHDACFSLDG

SEQ ID NO: 49843 - DNA, 697 bp, Panicum virgatum
  misc_feature: Ceres CLONE 2052703
  misc_feature: Encodes the peptide sequence at SEQ ID NO. 49844
acacctctagttttcacggccctgccgcagcaaagaacaaagagagaggaaggggaaaaaaaaggcgacgcgcctcgctctcgccaagtcccctgctccagaagaccactcggatcccaatccgagccttgctcatcttcggcgtcgacggtcccaccaccgagagcccgcgcgggctagccagccacgcagcggcgtggtctgggtggaagacggtagcggggagccggagggatggaccccgagaagcgcggctacaggctccaggagtttgtggcgcacgatgctgacgtgaggtccctggccatcggcaagaagtctagccgtgtcttcatcaccggaggcaatgatcgcaaggtcaacttgtgggccattggcaagcaaactccgcttctgagcttgtcaggccacacaagtgcggtggaggctgtgcagtttgattcagcagagatgcttgtgcttgctggctcatcaaatggttccatcaagctgtgggacttagaggaagctaaagttgtgcgatctcttaccgggcatagatcgagttgcacttctgttgaattccatccattcggcgagttttttgcatctggttcatcagatacagacctgaagatatgggatataaagaaaaagggatgcattcacacatataaaggtcaaaaaggaacaattaaaagaatcaggtttacccctg

SEQ ID NO: 49844 - protein, 154 aa, Panicum virgatum
  misc_feature: Ceres CLONE 2052703
  misc_feature (92)..(130): Pfam Name: WD40 Pfam Description: WD domain, G-beta repeat
  misc_feature (50)..(88): Pfam Name: WD40 Pfam Description: WD domain, G-beta repeat
  misc_feature (7)..(46): Pfam Name: WD40 Pfam Description: WD domain, G-beta repeat
  misc_feature: SWISSPROT Homolog: EC 2.7.11.7 [Myosin heavy-chain] kinase
MDPEKRGYRLQEFVAHDADVRSLAIGKKSSRVFITGGNDRKVNLWAIGKQTPLLSLSGHTSAVEAVQFDSAEMLVLAGSSNGSIKLWDLEEAKVVRSLTGHRSSCTSVEFHPFGEFFASGSSDTDLKIWDIKKKGCIHTYKGQKGTIKRIRFTP

SEQ ID NO: 49845 - DNA, 725 bp, Panicum virgatum
  misc_feature: Ceres CLONE 2052723
  misc_feature: Encodes the peptide sequence at SEQ ID NO. 49846
agttggggtgtccactctccccgacggaggccggagccacgggcacaatgccgacgcgcctccactacctcctgctccccctcctcctcgccgccgccgctgccgtcgcggcggacgcggacgcggacgcggacgcgctgctcgcggcgaaggcggcgctcgcggacccggccggcgcgctggtgtcctggacggcgagcgccaccccgtgcgcgtgggccggcgtgacgtgcaacgcgcgcgcggcggtcatcggtctcgacctctccggccgcaacctctcgggccccgtcccggcggcgctctcccgcctggcgcacctcgcgcggctcgacctcgccgcgaacgcgctctcgggccccatcccgccggcgctggcaaggctccagtccctcacccacctcaacctctccaacaacgtgctcaacggcaccttcccgccgccgctggcgcgcctgcgcgcgctccgggtgctcgacctctacaacaacaacctcaccggcccgctcccgctcgaggtcgcggcgctgccgctgctgcgccacctccacctcggcggcaatttcttctccggcgagatcccgcccgagtacggccgctggggcacgctgcagtacctcgccgtctccggggacgagctgtccggggagatcccgccggagctcggcaacctcacctgcctcaaggagctctacattggctacttcaacagctactccgggggg

SEQ ID NO: 49846 - protein, 225 aa, Panicum virgatum
  misc_feature: Ceres CLONE 2052723
  misc_feature (24)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MPTRLHYLLLPLLLAAAAAVAADADADADALLAAKAALADPAGALVSWTASATPCAWAGVTCNARAAVIGLDLSGRNLSGPVPAALSRLAHLARLDLAANALSGPIPPALARLQSLTHLNLSNNVLNGTFPPPLARLRALRVLDLYNNNLTGPLPLEVAALPLLRHLHLGGNFFSGEIPPEYGRWGTLQYLAVSGDELSGEIPPELGNLTCLKELYIGYFNSYSG

SEQ ID NO: 49847 - DNA, 532 bp, Panicum virgatum
  misc_feature: Ceres CLONE 2052737
  misc_feature: Encodes the peptide sequence at SEQ ID NO. 49848
ccttttacccttcacaccccgtgtaccagtagtaccaccgcccgctaccgctagccgccgcgctactgctctggtggcggctcacctccctcccccacccccgcccgccgccgccgtctcctcctctcgcgccccctccctccctaccccgagctagctcggagctacctatcccagggagagagagagagagagaggggagaagggccggtcggtcgggggctctcggatctcgttgctgcctccccgttggttgggatctcgcccgtgctcacaccatggcagccatcgcgccgcccccgtcccccgcgcccgccgcgccggcgccgactgccgccgccgccgccgcccatacagacccggctcctgccaccgtccctgtcgcagatgcaaaccacggatctgctgcctaagctgtgcctggattcggagcccaacgcggccgaggcaacctagcctaccagtaacaagaaggatgccgcatctagccagccactgagacgtgacgatccccccggaacggacgtttaca

SEQ ID NO: 49848 - protein, 44 aa, Panicum virgatum
  misc_feature: Ceres CLONE 2052737
  misc_feature: Functional homolog of the protein sequence given in SEQ ID NO 50464
  misc_feature: Useful for making plants with altered carbohydrate content
  misc_feature: Functional homolog of the protein sequence given in SEQ ID NO 51779
  misc_feature: Useful for making plants with altered cell wall content and/or composition
MAAIAPPPSPAPAAPAPTAAAAAAHTDPAPATVPVADANHGSAA

SEQ ID NO: 49849 - DNA, 627 bp, Panicum virgatum
  misc_feature: Ceres CLONE 2052758
  misc_feature: Encodes the peptide sequence at SEQ ID NO. 49850
cttttttcttcctccgattcgatttctcccaccgccttcctcctctcgcgcccgtactcctaccttcctttcgagtttcgccgatctcactacggattcggcgcctgccgccggagccttgtctcctggagaggcgatttcctctttttgccggcggcccttcttcagtgtgcaagatcagtcctcggtcatcggcaccagagatttctctgctgaggtttcactgcgccacaatgcctcttgttacggccgccgccccagctagcggctcaccgcgcggggtgattccgctgcgatcgagccgagcgtcttgtgactctcgtccttgtgccgctagagcatatgctggcaagaggttggtagcagaaaatacaagggtgcaaaacgtgcataggatggaactggagactagaataaggaaccagctcctgagacccgaattgccaccttcttcatatgacacggcttgggtttctatggtgcccttgcggggtactcatcagtctccatgcttcccacagtgtgttgagtggatattgcagaaccaacaggatgatggatcttggggtgtcaaccaatttgactcatcagtcaacaaggatgttcttttatccactttggcatgtg

SEQ ID NO: 49850 - protein, 131 aa, Panicum virgatum
  misc_feature: Ceres CLONE 2052758
  misc_feature: SWISSPROT Homolog: EC 4.2.3.19 Ent-kaurene synthase
MPLVTAAAPASGSPRGVIPLRSSRASCDSRPCAARAYAGKRLVAENTRVQNVHRMELETRIRNQLLRPELPPSSYDTAWVSMVPLRGTHQSPCFPQCVEWILQNQQDDGSWGVNQFDSSVNKDVLLSTLAC

SEQ ID NO: 49851 - DNA, 365 bp, Panicum virgatum
  misc_feature: Ceres CLONE 2052760
  misc_feature: Encodes the peptide sequence at SEQ ID NO. 49852
ctagtcatccatcgtattcatattccggcatccatcgatccttcctccgttttccaccactgttggtggccatcactgctcagtcatcccagcccaaggttgcttgcttttgctcccttgcatagccgcccggccatggagaaggagatcaataatccgccgccgcacacggccgagcccaaggacaccacaaccgccacttcatcaccaacagcagagaaccctgcatcgtcgtccgacgaccagcgaccgctgcggccgcatctctccatcgacatcccggcgtcaagcctgcccggcgaccccctcccgacgccgacggaggccgccgacatcaccctaaccccgacggggttgctcctcca

SEQ ID NO: 49852 - protein, 76 aa, Panicum virgatum
  misc_feature: Ceres CLONE 2052760
  misc_feature: SWISSPROT Homolog: EC 2.7.11.1 Non-specific serine/threonine protein kinase
MEKEINNPPPHTAEPKDTTTATSSPTAENPASSSDDQRPLRPHLSIDIPASSLPGDPLPTPTEAADITLTPTGLLL

SEQ ID NO: 49853 - DNA, 714 bp, Panicum virgatum
  misc_feature: Ceres CLONE 2052761
  misc_feature: Encodes the peptide sequence at SEQ ID NO. 49854
cgtaggtggagaggcgtctatataagcagctgggagtaagagggcacatacattctccgcttgcatctctaattccctacaagtagaaagggatatttattccttcagctccacaatctgtaggcatcggcaggtacgtagcatgatacattttagaatcctatgtctgaatctcgttccagtcctttatctcttcatcctagtgtgctctttagctcttgtcatcagcagccaaaatgaaactgacaaagaacgacaagctcttctatgcttcaagtcccggctatcagatccagccggagccttattctcatggagcaacgcataccttgatttctgcaactggcatggtgtaagctgcggtgcagagtctcctcaccatgttacttcactagacctctcttctgaaggcctcagtgactctataccatcttgcataggcaaccttacctcacttaagaggttgcagttgtcaaataacagcttccatggctccatacctcccgagcttggtctcctaacccagcttacctacctcaacctcagcatgaattctctgaatggtgggatcccatctacgatctcagcctgcaatcaacttcatgtcatcgacctattgaacaactccctcgaaagtgatatcctaccaaccttaagccattcaaaaacatccaaacgataaaccttagtaacaacaagctgcaagggagcatc

SEQ ID NO: 49854 - protein, 179 aa, Panicum virgatum
  misc_feature: Ceres CLONE 2052761
  misc_feature (34)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MIHFRILCLNLVPVLYLFILVCSLALVISSQNETDKERQALLCFKSRLSDPAGALFSWSNAYLDFCNWHGVSCGAESPHHVTSLDLSSEGLSDSIPSCIGNLTSLKRLQLSNNSFHGSIPPELGLLTQLTYLNLSMNSLNGGIPSTISACNQLHVIDLLNNSLESDILPTLSHSKTSKR

SEQ ID NO: 49855 - DNA, 383 bp, Panicum virgatum
  misc_feature: Ceres CLONE 2052851
  misc_feature: Encodes the peptide sequence at SEQ ID NO. 49856
accttgggcccaagcacccgcaaatatctgtcgccttctcgcgtctctctcgctaaccgcgccaaccgcatcgtccatttcgacagccatggcgagcgaaggcgagccttcttcctccgatccgaaggggaagaaggactactcgccggcgatcctctataagaagaagtcgccgaaccggctggtggtcgacgaggccactaatgacgacaactccgttgtcgcactgcacctggacaccatggagcgccatcatctctcccgcggtgacactgtcctgcttaaaggcaagaagagaaaggaccctagctgcatcgtgcttgctgatgacacttgcgatgagccaaaacacaagatgaacaatgttgtcaagaagaacttgc

SEQ ID NO: 49856 - protein, 98 aa, Panicum virgatum
  misc_feature: Ceres CLONE 2052851
  misc_feature (28)..(98): Pfam Name: CDC48_N Pfam Description: Cell division protein 48 (CDC48), N-terminal domain
MASEGEPSSSDPKGKKDYSPAILYKKKSPNRLVVDEATNDDNSVVALHLDTMERHHLSRGDTVLLKGKKRKDPSCIVLADDTCDEPKHKMNNVVKKNL

SEQ ID NO: 49857 - DNA, 617 bp, Panicum virgatum
  misc_feature: Ceres CLONE 2052852
  misc_feature: Encodes the peptide sequence at SEQ ID NO. 49858
catggagaaacagatcttttgggtctgcacttgaatttgtttggtcaactgatggagaatatgcagtcagagaaagcacctctaggataaagatatacagtaaaaatttccaggagaagaaaagtataaggccatcattttccgcagaacgtatatttggcggagtgttactagctatgtgtacaaatgactttatttgcttctatgattgggcggaatgcaggttaatacgtcgaattgatgtcaatgtgaagaatctttactgggccgacagtggtgacttagtaacaattgcaagtgacacatcattctacatattgaagtataatagggatgtagtttcatctcatttggatggagggggttcagttggtgaggaaggtgtggaagatgcctttgagctgcttcatgagatcaacgaacgtgttcggactgggctatgggttggcgattgtttcatctacaataattcttcatggcggcttaattactgtgtaggaggagaggtcacaaccttgtttcacttggatcggccaatgtatttattaggatatcttgcaaaccaaagccgtgtctatcttatcgataagcaatttaatgttgtggggtatacttta

SEQ ID NO: 49858 - protein, 204 aa, Panicum virgatum
  misc_feature: Ceres CLONE 2052852
  misc_feature (1)..(204): Pfam Name: Coatomer_WDAD Pfam Description: Coatomer WD associated region
WRNRSFGSALEFVWSTDGEYAVRESTSRIKIYSKNFQEKKSIRPSFSAERIFGGVLLAMCTNDFICFYDWAECRLIRRIDVNVKNLYWADSGDLVTIASDTSFYILKYNRDVVSSHLDGGGSVGEEGVEDAFELLHEINERVRTGLWVGDCFIYNNSSWRLNYCVGGEVTTLFHLDRPMYLLGYLANQSRVYLIDKQFNVVGYT

SEQ ID NO: 49859 - DNA, 731 bp, Panicum virgatum
  misc_feature: Ceres CLONE 2052864
  misc_feature: Encodes the peptide sequence at SEQ ID NO. 49860
ctgactccaaaagcgggacaggacaaggcggtgacggagagtaccgaaaaagaaagaggccggccgccctcggcggcgccggcgtctttggatcctccgcccgccggaccggccttatttccctcgccgcctgctccgcgtcctgcgtgcttgccgccctgctgcattgcacacactcgcaggtttcagcacttcttgacactccatagtttggaagcaatataagcagatttttagaaatatgaacccgtatttctttggtttccttctcccttttgtcgcgtctctgctgctcaccaaaaggaaatctgagaagaagaggggagtaccagtagatgtgggtggagagcccggctgcgccgtccgtaaccacagatttgaaaggcccatcgaaacgcactgggagggggtttccacgcttgcggagctatttgagcaatcatgtgagcagttcgcctacatgcccctgtatggcaccaggaagctaattgcaagggagttggaggtggctcccgatggaagatcctttgagaagctccatttgggagattatgagtggaaaagctatgctgatgcgttcaagactgtatgcaacttctcgtctggcctactgagaactgggcacctcaaggatgagcatgttgctatatttgctgatactcgggctgagtggcagattgcgttgccggcgtgcttcagacaaaacattacagttgtcacatctatgcctc

SEQ ID NO: 49860 - protein, 163 aa, Panicum virgatum
  misc_feature: Ceres CLONE 2052864
  misc_feature: SWISSPROT Homolog: EC 6.2.1.3 Long-chain-fatty-acid--CoA ligase
MNPYFFGFLLPFVASLLLTKRKSEKKRGVPVDVGGEPGCAVRNHRFERPIETHWEGVSTLAELFEQSCEQFAYMPLYGTRKLIARELEVAPDGRSFEKLHLGDYEWKSYADAFKTVCNFSSGLLRTGHLKDEHVAIFADTRAEWQIALPACFRQNITVVTSMP

SEQ ID NO: 49861 - DNA, 669 bp, Panicum virgatum
  misc_feature: Ceres CLONE 2052900
  misc_feature: Encodes the peptide sequence at SEQ ID NO. 49862
gtccccacgtgacagcgaagcagagctttccgtcactctcatcacactacccacctcctccctccgccgccgccgccgcctctgctgccgtcgccatggcagcagcgcccaccggcggccccgccgtcaccgcgtcctcctcctcctcctttctctctccgtcgccgttctctctcaaggcgtcgaggatcaggcgatcagccaccgccgacccgcggggagaatgcctgtcaccgtccgctgcgtcagtagtctgccggccgccgatacatgtactaccaagccctgatatacttcatcgctaatggtttccaatgtccatcctgctcgctgaaattcacgtctcagttctagtctctattaggttccgtttgaggcgtccagtcgaatgctacaggtgctagttcgaattagggcattattctagttttctgttcgctgtggtatctccttgtttggttggtgttgcggtcatgtacggagttgcctggagatgttgtgggaacataaatacggatgttgtttcctgatattttcttcctcctgtcctgaagcttacaagactagtgtcccgcgcaatgccaacatggccaaactccaagcaggatatttgtttcctgagatttgcaggagaagagcagctcatttgctgaagtaccctgatgctaa

SEQ ID NO: 49862 - protein, 58 aa, Panicum virgatum
  misc_feature: Ceres CLONE 2052900
  misc_feature: SWISSPROT Homolog: EC 2.6.1.83 LL-diaminopimelate aminotransferase
MLWEHKYGCCFLIFSSSCPEAYKTSVPRNANMAKLQAGYLFPEICRRRAAHLLKYPDA

SEQ ID NO: 49863 - DNA, 260 bp, Panicum virgatum
  misc_feature: Ceres CLONE 2052905
  misc_feature: Encodes the peptide sequence at SEQ ID NO. 49864
gtactgctgagaaggtcgccgccggtgaagcgcgcctcgatcgagatcggagtaagagatggctctcacgagaattggtctctctggcctcggagtcatggggcacaaccgtgccctcactattgcggagaaagggttctccaactctgtctactgcaggacaacctccacggtggatgagacagtgcagcgcgccaagctggaaggaaacctccctgtgtatggtttccatgaccctgcatccttcgtgagctcctttc

SEQ ID NO: 49864 - protein, 67 aa, Panicum virgatum
  misc_feature: Ceres CLONE 2052905
  misc_feature: SWISSPROT Homolog: EC 1.1.1.44 Phosphogluconate dehydrogenase (decarboxylating)
MALTRIGLSGLGVMGHNRALTIAEKGFSNSVYCRTTSTVDETVQRAKLEGNLPVYGFHDPASFVSSF

SEQ ID NO: 49865 - DNA, 421 bp, Panicum virgatum
  misc_feature: Ceres CLONE 2052947
  misc_feature: Encodes the peptide sequence at SEQ ID NO. 49866
aaaccattcgcacaccatgcacccgagtcccgaccccgtccgtgcgccgctctccccccgccgccgacccctgccgctccggcgagcccccatcgaaggctgcgtcagccatgatggagatcctgcacatccagggcgggcagtgcgggaaccagatcggcgccgagttctgggaggagatctgcgacgagcaccgcatcgacgccacgggccgctacgcggaggacttctacctccagctcgagcgcattaacgtctactacaacgaggtcagcgggggccgcttcgtgtcgcgcgccgtgctcatggacctggagcccgggaccatggactcggtgaggtcgggccccttcagccaaatgttccgccccgacaacttcgtcttcggccagtccggcgcccgctacaactgggccaaggg

SEQ ID NO: 49866 - protein, 103 aa, Panicum virgatum
  misc_feature: Ceres CLONE 2052947
  misc_feature: Functional homolog of the protein sequence given in SEQ ID NO 50258
  misc_feature: Useful for making plants with modulated flowering time
MMEILHIQGGQCGNQIGAEFWEEICDEHRIDATGRYAEDFYLQLERINVYYNEVSGGRFVSRAVLMDLEPGTMDSVRSGPFSQMFRPDNFVFGQSGARYNWAK

SEQ ID NO: 49867 - DNA, 645 bp, Panicum virgatum
  misc_feature: Ceres CLONE 2052962
  misc_feature: Encodes the peptide sequence at SEQ ID NO. 49868
aacctgaccagtgaccaccgcgtccactacacgatgctgtcaacctgtcgtcgaccagagagctagctgccgctgcgctagttcacctccacctcgccgcgatggcgcccaaccaccggctccgcctccgcctcgccttgggtgttccgctgctgctgctgcttctccccgcggcttcccgcgccagggacaccatcgcgccgggccagccgctccggggcaacgacacgctcgtctcctcgggcagcggcagcttcgcgctcggcttcttctccccgccgggctccaacaacacctacgtcggggtctggtacgccaggctgcccgtccgcaccgtcgtctgggtggccaaccgcgccaacccggtccgcggcgccgccgccggcgccacgctctccgtgtcgcccgccggcgccacgctctccgtgtcgcccgccggctgcgcgctcgccgtcacggacgccaacggcaccgtggtgtggtcggcgtccccggcggcaggctcggagggcgcgtgcgcggcgcggatccaggacgacggcaacctggtggtgtcggaccagcgcgggcgcgtggcgtggcaggggttcgaccaccccaccgacacgctcctcccggggatgcgcctcggggtggacttcgcag

SEQ ID NO: 49868 - protein, 181 aa, Panicum virgatum
  misc_feature: Ceres CLONE 2052962
  misc_feature (76)..(181): Pfam Name: B_lectin Pfam Description: D-mannose binding lectin
MAPNHRLRLRLALGVPLLLLLLPAASRARDTIAPGQPLRGNDTLVSSGSGSFALGFFSPPGSNNTYVGVWYARLPVRTVVWVANRANPVRGAAAGATLSVSPAGATLSVSPAGCALAVTDANGTVVWSASPAAGSEGACAARIQDDGNLVVSDQRGRVAWQGFDHPTDTLLPGMRLGVDFA

SEQ ID NO: 49869 - DNA, 615 bp, Panicum virgatum
  misc_feature: Ceres CLONE 2053013
  misc_feature: Encodes the peptide sequence at SEQ ID NO. 49870
aatatgagaaggtattccagaaaccgtgagttgatcagaattcagaagcaatgagttacctgctcaagaccaggaaggagagggaaccacccctgcaggagcatgcggcttcagaagaacaggcaaagataaataaggtacgggaacttctgggtgagctgccgacagagatgccgggcttcctgtcggacgccaccatccgccgcttcctccatgcaaaaaattggagcgtggttcaggccaccaagactctgaaagaagctgtcaaatggaggcgtcagtacaagccagaaaaaatctgttgggaagacattgctgaacccgagaatgaggtgcagagagcgtatataaccgactaccttgacaaaaatgggcgtactgtgttggtagcacggccgtcagtaaagagcctaacttcagtgaaggaacagatcaaacaactagtgtacaacctggaaaatttgaccatgagctcagagaatgcaccagaaaatgttgtttgggtaattgacttccaaggatggacactatcaagtacgccattggcaatgagccgtcaatcattggacataattcagaactattatccaggatactgagttacttcgtcgagcc

SEQ ID NO: 49870 - protein, 182 aa, Panicum virgatum
  misc_feature: Ceres CLONE 2053013
  misc_feature (14)..(83): Pfam Name: CRAL_TRIO_N Pfam Description: CRAL/TRIO, N-terminus
MSYLLKTRKEREPPLQEHAASEEQAKINKVRELLGELPTEMPGFLSDATIRRFLHAKNWSVVQATKTLKEAVKWRRQYKPEKICWEDIAEPENEVQRAYITDYLDKNGRTVLVARPSVKSLTSVKEQIKQLVYNLENLTMSSENAPENVVWVIDFQGWTLSSTPLAMSRQSLDIIQNYYPGY

SEQ ID NO: 49871 - DNA, 641 bp, Panicum virgatum
  misc_feature: Ceres CLONE 2053058
  misc_feature: Encodes the peptide sequence at SEQ ID NO. 49872
atggagagtcaacgcagcagcagcggtagagaagaaaccctcaacggtagtcctcacctcaaagccccactcaacacgctccatgtcgaccgctgcacccccgcgcaccgcgtgcacgcgctcctctacgccggcgccatcctcggcctggtgtgccaccggctgacctccattctagcctcctcctcgctcgccgagggatggatgctgctggcggagctcgtcctggccttcatgtggggctgctcgcgggcgttcaagtggcagccggtgcgtcgccgggagttccccgacagattgccggagggtggcgcctggccgaagctcgacgtgttcgtgtgcacggctgatccgaggaaggagcccccggtcggggttgtgagcacagccctctcggccatggccttcgagtaccccgcgggcaagctgtcggtgtatgtttccgacgacggcggcgcggatgtgacgctgttcgcgttcatggagggcgccaggttcgcgcggtactggctgccgttttgcagggagaatggcgtgcaggtgcggtcgccggaggtgttctttgcttcttcttcttcttcttcttcttcttctggatgttctgccggtggcggcgatgcggataagctgaaggtgatgta

SEQ ID NO: 49872 - protein, 145 aa, Panicum virgatum
  misc_feature: Ceres CLONE 2053058
  misc_feature: SWISSPROT Homolog: EC 2.4.1.12 Cellulose synthase (UDP-forming)
  misc_feature: Functional homolog of the protein sequence given in SEQ ID NO 51780
  misc_feature: Useful for making plants with altered cell wall content and/or composition
MLLAELVLAFMWGCSRAFKWQPVRRREFPDRLPEGGAWPKLDVFVCTADPRKEPPVGVVSTALSAMAFEYPAGKLSVYVSDDGGADVTLFAFMEGARFARYWLPFCRENGVQVRSPEVFFASSSSSSSSSGCSAGGGDADKLKVM

SEQ ID NO: 49873 - DNA, 649 bp, Panicum virgatum
  misc_feature: Ceres CLONE 2053095
  misc_feature: Encodes the peptide sequence at SEQ ID NO. 49874
agcctgcctgagatctctcgtcagtcaccagatccgagccccgaatccgcgcggcggcaatggcggtgcgcgcgagcctcggctgcttcccctccgatcccactctccacgcctcctgcggcatgccgtggggcgtcgccgtcacgcccttctccgccgccgacgagcgcggctccccgccggccgccggcgacgagggccacctcctcccgcgctgccagtcctgcttcgcctacttcagcctgctctgcccgctcgaccgctggtcctggacctgcgccgtctgcggcggggagaacgacatgcccgccgacgccgccgcgcggtacgcccgcgacggcgcccacgacccgcccgagacgcgctccgcgttcgtcgacctcctgctccagggagaggagggcgaggcggcagcggcagcggcagctccgacacccgtgtacgtggcggcgatcgacttgtcctcttcagaggagtttttggagctagtcaaaagtgctctacaagcagctctggaagctctttcaccaggatcattatttggactcttgacatttagcagtaagataggattgtatgatgtccaaggtccaatacctattgtgaagaatgtgttcatccctcctgattctgatggcgccttaccaat

SEQ ID NO: 49874 - protein, 196 aa, Panicum virgatum
  misc_feature: Ceres CLONE 2053095
  misc_feature (49)..(86): Pfam Name: zf-Sec23_Sec24 Pfam Description: Sec23/Sec24 zinc finger
MAVRASLGCFPSDPTLHASCGMPWGVAVTPFSAADERGSPPAAGDEGHLLPRCQSCFAYFSLLCPLDRWSWTCAVCGGENDMPADAAARYARDGAHDPPETRSAFVDLLLQGEEGEAAAAAAAPTPVYVAAIDLSSSEEFLELVKSALQAALEALSPGSLFGLLTFSSKIGLYDVQGPIPIVKNVFIPPDSDGALP

SEQ ID NO: 49875 - DNA, 624 bp, Panicum virgatum
  misc_feature: Ceres CLONE 2053122
  misc_feature: Encodes the peptide sequence at SEQ ID NO. 49876
gctgtcctcgagccttcgctactttctcctcttctccggctctgctcacccaactggatctgtggacggatgatcatttgacccccttatgaattgaatactctgcagaacgccagtaaattgactacccaacccgcatccgccggccggccgtcttccgctagccacccgcatcgatggcggtcgtcgaagaagatgcggcgcctgcagccgccgcctccgcttctgatcccaccgctggctccagtgataatgagattacagtggaagaggcgtcttttgtgcatactgaacctccccaggatggcagtgccccacccgtggtttcctctgctatggaagtccttcatgataaagtcaagaaacaggtcatcaaagaaggacacggcaagaaaccattaaagttcgcgacgtgctttggtaagtaatggcgcaagtgattgttccagtgcttgggatgttggtagttggtactttctagataagagttttttttggaaagaaggtagacaagagttccttatgttatatttatgatcatatcttgttatgtttgtttgcactgttttccctctcatgatggctgggggaacatatgtaactttacaagtttacatgttcatc

SEQ ID NO: 49876 - protein, 83 aa, Panicum virgatum
  misc_feature: Ceres CLONE 2053122
  misc_feature: SWISSPROT Homolog: EC 5.2.1.8 Peptidylprolyl isomerase
MAVVEEDAAPAAAASASDPTAGSSDNEITVEEASFVHTEPPQDGSAPPVVSSAMEVLHDKVKKQVIKEGHGKKPLKFATCFGK

SEQ ID NO: 49877 - DNA, 667 bp, Panicum virgatum
  misc_feature: Ceres CLONE 2053132
  misc_feature: Encodes the peptide sequence at SEQ ID NO. 49878
aaaaccccgcagtcccgcactcgagagcggcgtctgcattccccattcgttccccctcttccccgattcgatccagcaccacgccgccgcccgccgacgaggacgcgcgccgagcctagagcgcaaccatgcgacgggacgacgccggcggcggatccgggttccacgacttgttcgactccgtgcgccgctccatctccttccgccccgccgccgcggccgccggcctggagcctcccgcgggcccattcggcgcggggggcggagggatcggtttgcggatcagttcctgcatccggaagtcccgcgggatggggctgcttgggctcatcacgaagaacccctccccgccgcgccgcatgctgccgccgatgcccgacgaggcggtcggcggcagcgggggatgcggcagaggtggagaggagaacccgccgatccggtggcggaagggggagctaatcggggcgggcgcttttgggcaggtctaccttgggatgaacctggactccggcgagctcctcgccgttaagcaggttttgatcggcactagcaacgcgacgcgggagaaggctcaagcacatattagagagctcgaagaagaagtgaagctactcaagaacctgtcgcacccccacatcgtttgggatcttgggactgtgcgggagga

SEQ ID NO: 49878 - protein, 179 aa, Panicum virgatum
  misc_feature: Ceres CLONE 2053132
  misc_feature: SWISSPROT Homolog: EC 2.7.11.25 Mitogen-activated protein kinase kinase kinase
MRRDDAGGGSGFHDLFDSVRRSISFRPAAAAAGLEPPAGPFGAGGGGIGLRISSCIRKSRGMGLLGLITKNPSPPRRMLPPMPDEAVGGSGGCGRGGEENPPIRWRKGELIGAGAFGQVYLGMNLDSGELLAVKQVLIGTSNATREKAQAHIRELEEEVKLLKNLSHPHIVWDLGTVRE

SEQ ID NO: 49879 - DNA, 601 bp, Panicum virgatum
  misc_feature: Ceres CLONE 2053140
  misc_feature: Encodes the peptide sequence at SEQ ID NO. 49880
aactcctcgctctctttcgatcgtatcgcgcggcgccctcctcgccctcagccgcctggcaagcctaggctcccgactccggtcgccgccgccgccgccgccgccgtcccagttctaggagctgggccggcaccccttcagtactttgacgcacgctacaggatagattcctttggacgaattgtggaagccttatacactgttgtacaaggcagctgcattgaagatgtctgagttccttgacctagaggcacaagatgggataaggatgccctggaatgttattccaggcacaaagcaggaggctttgaactgtgtgattcctgtttccgctatctatacacctctgaagtcaattcctgatattccggttctcccatactcacctcttcgctgtcgcatgtgtcgttccatcctcaatcctttctccattgttgactatgttgctaagatctgggtctgtccattctgctttcagcgcaatcaattccctcaacactactcctccatctcagaaaataacctccctgcagaactctttcctcagtataccaccgttgagtacatgacgtcaaccgaaactggtcctgtagtgccaccg

SEQ ID NO: 49880 - protein, 124 aa, Panicum virgatum
  misc_feature: Ceres CLONE 2053140
  misc_feature (53)..(92): Pfam Name: zf-Sec23_Sec24 Pfam Description: Sec23/Sec24 zinc finger
MSEFLDLEAQDGIRMPWNVIPGTKQEALNCVIPVSAIYTPLKSIPDIPVLPYSPLRCRMCRSILNPFSIVDYVAKIWVCPFCFQRNQFPQHYSSISENNLPAELFPQYTTVEYMTSTETGPVVP

SEQ ID NO: 49881 - DNA, 589 bp, Panicum virgatum
  misc_feature: Ceres CLONE 2053161
  misc_feature: Encodes the peptide sequence at SEQ ID NO. 49882
acacataacatgacagttgatttactcagtagatcatttgataagcagtcataagctgttcgatgtgagccatggattggttcagcataccttgacgacgacatcccatcatctctgattgaaacttggcgaaatcctgtactattatatgcagatttacatttacctacgaagaatgaatttatcccaacggactttactctgccaaacacaaactctcctacatgctcaagtgaagataaccctcgttgcattgtggatgagccactcataaaactctggtacaacatggacatgacattcaatgtccctcgtgcgaacacttactttttgatttctgtcatggatggctataccagcctccaaaacgctgtcctgacacagctgttcacaaaccttctcaaagatgaacttaatgaggtcctctatcacgcttatgtggctaaactggagactactatatctgttattggcagcaaacttgagataaagctttttggttacaatgacaagcttccaatcctgctgtccaacatcttgtctacttttcaatccttttctccgaagacagataggtttgaggtcatca

SEQ ID NO: 49882 - protein, 100 aa, Panicum virgatum
  misc_feature: Ceres CLONE 2053161
  misc_feature: SWISSPROT Homolog: EC 3.4.24.56 Insulysin
MDMTFNVPRANTYFLISVMDGYTSLQNAVLTQLFTNLLKDELNEVLYHAYVAKLETTISVIGSKLEIKLFGYNDKLPILLSNILSTFQSFSPKTDRFEVI

SEQ ID NO: 49883 - DNA, 659 bp, Panicum virgatum
  misc_feature: Ceres CLONE 2053162
  misc_feature: Encodes the peptide sequence at SEQ ID NO. 49884
ctcgaaaccctagtccctacaacgcagccgccactccgcccctttctctccgtctccacctccgttagggaagaaccaaccactcggagatggcgggcaagggcgaggggccggcgatcggcatcgacctcggcacgacctactcgtgcgtcggcgtgtggcagcacgaccgcgtcgagatcatcgccaacgaccaggggaaccgcaccacgccgtcctacgtcgccttcaccgacaccgagcggctcatcggagatgccgccaagaaccaggtcgccatgaaccccatcaacacagtcttcgatgccaagcgtctcatcggcagaaggttctctgactcttcggtccagagcgatattaagctctggcccttcaaggtcatcgctggacctggtgagaagcctatgattgttgttcagcacaagggtgaggagaagcagtttgcagctgaagagatctcctctatggttctcattaagatgcgtgagattgctgaagcttaccttggcagcactgtcaagaacgctgttgtcacagttcctgcctacttcaacgactctcagaggcaggccactaaggatgctggtgtgattgctggtcttaatgttctccgtatcatcaatgagcccaccgctgctgctattgcctatggtcttgac

SEQ ID NO: 49884 - protein, 189 aa, Panicum virgatum
  misc_feature: Ceres CLONE 2053162
  misc_feature (9)..(189): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAGKGEGPAIGIDLGTTYSCVGVWQHDRVEIIANDQGNRTTPSYVAFTDTERLIGDAAKNQVAMNPINTVFDAKRLIGRRFSDSSVQSDIKLWPFKVIAGPGEKPMIVVQHKGEEKQFAAEEISSMVLIKMREIAEAYLGSTVKNAVVTVPAYFNDSQRQATKDAGVIAGLNVLRIINEPTAAAIAYGL

SEQ ID NO: 49885 - DNA, 538 bp, Panicum virgatum
  misc_feature: Ceres CLONE 2053175
  misc_feature: Encodes the peptide sequence at SEQ ID NO. 49886
atcgacactctcccaccaccgccaccgccgctgcggctcacggctacgcagcccgctctcccctccgtccggccgtcccctcccccccccccccaccccccctctctccggttgcttcgagggttcgccccgaatcgatcgcccgactgaccccgctagggttcggcccgatcgcccgccgcttcgtcctccccgcgggggtttccccgacgcgatgtccgaccggagctcgccggccgcgccgacgttcttccccttcggcccgcaggccgaggcgtgggacgtcacgttcaaggtcaaatatggggacacacttaagaggttttatggttgtgtcaatggagctcattttgacatgaatttatctgctctacgggcaaagatagccactgcctttaagtttggtcctgatgccaacttcattctgacttacatcgatgaggatggtgatgctgtaatgctagacgatgatgatgacctgcgcgatgcagctctgcgtcagaaattaaaccctctgaggattactgttcaactaaag

SEQ ID NO: 49886 - protein, 107 aa, Panicum virgatum
  misc_feature: Ceres CLONE 2053175
  misc_feature (23)..(107): Pfam Name: PB1 Pfam Description: PB1 domain
MSDRSSPAAPTFFPFGPQAEAWDVTFKVKYGDTLKRFYGCVNGAHFDMNLSALRAKIATAFKFGPDANFILTYIDEDGDAVMLDDDDDLRDAALRQKLNPLRITVQL

SEQ ID NO: 49887 - DNA, 681 bp, Panicum virgatum
  misc_feature: Ceres CLONE 2053215
  misc_feature: Encodes the peptide sequence at SEQ ID NO. 49888
gatctcgatctcttcttgctctttcctcttggtcttttcgtcctcctttcggggaagagctagctttctgacacacctccttgcgctggctagctagcatgatgtgcagtgccaatcttgagccttgcgtgagtcgtcactacttgagtttgttctcgccatgtctcagtctagtgttttgttttggtgaagggaggatagggaagatcgacagccctgcaagtccaatccagaaataagataaggctaccgaaagggaaaagattcccttgttcttgagcggttggtttgtcagggacaaatctggagggcgcgatggcatccaattcatcggcggcggctgtggcagcgctgtttggaattagggatggcgaccaccatcaggagcagattaagccgctgcttgcgcagccgcaccagcagctgcctcctgcgccactgctcaacgcggccgcctcgtcgtcggctcctgggtccgcccaggcggcggcggcggcgtcaccgccagtgaagaagaagagaaccctaccagaccctgacgcggaggtgatcgcgctgtcgcccaagacgctgctggcgacgaaccggttcgtgtgcgaggtgtgcaacaaggggttccagcgggagcagaacctgcagctgcaccggcgcgggcacaacctgccgtggaaactgaagcag

SEQ ID NO: 49888 - protein, 121 aa, Panicum virgatum
  misc_feature: Ceres CLONE 2053215
  misc_feature (92)..(114): Pfam Name: zf-C2H2 Pfam Description: Zinc finger, C2H2 type
  misc_feature: The sequence is a functional homolog of SEQ ID NO 1086 in the 10/666,642 US patent application
  misc_feature: The sequence is a functional homolog of SEQ ID NO 1719 in the 11/479,226 US patent application
MASNSSAAAVAALFGIRDGDHHQEQIKPLLAQPHQQLPPAPLLNAAASSSAPGSAQAAAAASPPVKKKRTLPDPDAEVIALSPKTLLATNRFVCEVCNKGFQREQNLQLHRRGHNLPWKLK

SEQ ID NO: 49889 - DNA, 329 bp, Panicum virgatum
  misc_feature: Ceres CLONE 2053234
  misc_feature: Encodes the peptide sequence at SEQ ID NO. 49890
atggcgtggaggtacaaccagcgctacggctgcggcggctgcgcgtacatggaggtggtcagcacgctgaaccaggaactccccctctccaactgcgcctacgtctttccaggcaacctcctccgcttccccaacgcgctcgccctcgtcgccgacttctgggtcttcaccctacgggcccatgatgctgtcacaactggacgcattgtatttaatgctattcaacatcgacaggccaaggtttcaactggtgattctgttacagtatagtagttttgcccctcctgatgatttcacgtaatcattgccctctttagaactagaatttg

SEQ ID NO: 49890 - protein, 89 aa, Panicum virgatum
  misc_feature: Ceres CLONE 2053234
  misc_feature: SWISSPROT Homolog: EC 3.6.4.6 Vesicle-fusing ATPase
MAWRYNQRYGCGGCAYMEVVSTLNQELPLSNCAYVFPGNLLRFPNALALVADFWVFTLRAHDAVTTGRIVFNAIQHRQAKVSTGDSVTV

SEQ ID NO: 49891 - DNA, 615 bp, Panicum virgatum
  misc_feature: Ceres CLONE 2053240
  misc_feature: Encodes the peptide sequence at SEQ ID NO. 49892
aatgcgagctctcgcggcagcagcaactgcagtggcggcgcctacccccgcgcgtctccgtctccggctcccgctcgccccccgcgccccgcgctccggtcactgtagagcagcttctcccccgaggctgctgaggagcgcctgcagcgcgaccaccatgggtgacgagcccacaacttcggcttctgttcctgtccagacgcaggaacctgtggagggcgctgggagcgtcaagcagcagctctccaagttggttgtttcgtcccttcgcacgacagtgcctgaggtggatgtagatcccatggttgaagtttgcacaggaaagtttggtgactaccagtgcaacaatgcgatgggattatggtcaaagattaaagggtctgggacaagtttcaaaaatcccaatgcaattggacaggccattgccaagaacttaccagcctctgatattatcgagtccacttctgttgctggacctggttttgtgaacattatcttatcaaaccgctgggttgcaaagagaatacaagacatgctagtggatggcattggaacttgggcaccaattctgccagtaaaagaggactgtgcttgacttctcatcacccaatattg

SEQ ID NO: 49892 - protein, 145 aa, Panicum virgatum
  misc_feature: Ceres CLONE 2053240
  misc_feature (27)..(114): Pfam Name: Arg_tRNA_synt_N Pfam Description: Arginyl tRNA synthetase N terminal domain
  misc_feature: SWISSPROT Homolog: EC 6.1.1.19 Arginine--tRNA ligase
MGDEPTTSASVPVQTQEPVEGAGSVKQQLSKLVVSSLRTTVPEVDVDPMVEVCTGKFGDYQCNNAMGLWSKIKGSGTSFKNPNAIGQAIAKNLPASDIIESTSVAGPGFVNIILSNRWVAKRIQDMLVDGIGTWAPILPVKEDCA

SEQ ID NO: 49893 - DNA, 635 bp, Panicum virgatum
  misc_feature: Ceres CLONE 2053279
  misc_feature: Encodes the peptide sequence at SEQ ID NO. 49894
acgaacacttcgaccaccccaaccatctcctccccgccgcgcccatctcttcctccctagccgccaccccgcgctctcactagccgccgccgccacactccacccgcgcacccgccgcgggcaggcggcgggagattatctgcgccgtccggcgggattgcgggaatttgattagtcggattccgctgcgagcgcgatggcagggagggtgccgatggagcggcaccagtcgatcgacgcgcagctgcggctgctggcgccaggcaaggtctcggaggacgacaagctcgtcgagtacgacgccctcctcgtcgaccgcttcctcgacatcctccaggacctgcacggcccgcacctccgcgaattcgtccaggagtgctacgagctctcggcggagtacgagaacgaccgcgacgaggcgcggctcgaggagctcgggagcaagctcaccagcctgcccccgggggactccatcgtcgtcgccagctccttctcgcacatgctcaacctcgctaacctcgctgaggaggtgcagatcgcgcaccgccgccggatcaagctcaagcgtggggacttcgccgacgaggcctcggcgcccaccgagtccgacatcgaggagacgctcaagcgcctgg

SEQ ID NO: 49894 - protein, 146 aa, Panicum virgatum
  misc_feature: Ceres CLONE 2053279
  misc_feature: SWISSPROT Homolog: EC 4.1.1.31 Phosphoenolpyruvate carboxylase
MAGRVPMERHQSIDAQLRLLAPGKVSEDDKLVEYDALLVDRFLDILQDLHGPHLREFVQECYELSAEYENDRDEARLEELGSKLTSLPPGDSIVVASSFSHMLNLANLAEEVQIAHRRRIKLKRGDFADEASAPTESDIEETLKRL

SEQ ID NO: 49895 - DNA, 722 bp, Panicum virgatum
  misc_feature: Ceres CLONE 2053296
  misc_feature: Encodes the peptide sequence at SEQ ID NO. 49896
ggaccggggtcgccattgctagctagcttatggtgtactcggatagatcgatgcgtgtgtcttgcacccacagagagagaggatgatcttggtctgagtgagcgttccccttagcacacagatcctcccattcttgtccgcctttgcaacttcttgatcgcttcattgcatctctagctacttcctgctacaccttctaccttcgtcttcggccaatctatagcttcatgaaaaatctgcagatctgcacagatcaataacactgagctagaatcgggttgtaatcttggtgcggctaattaaggaaatactgcggcgatggcactgtcagcttctctggttcggcaagaagtgccgccggggaggcagttgaggaaccagcttgctgcagccgcgaggagcatcaactggagttatgctctcttctggtccatctcaagcactcagccaggaatcctgacgtggacggacgggttctacaacggcgaggtgaagacgatgaagatcgccaactcggcggagctgacagccgagcagctcgtcatgcagagaagcgagcagctgcgggagctctacgaggccctcctctccggcgactgcgaccgccgcgcggcgcggccggtggcgtcgctgtcgctggaggacctcggcgacaccgaatggtactacgtcgtctgcatgacctacgcccttccggcctgggccaagggttgcccgggcag

SEQ ID NO: 49896 - protein, 134 aa, Panicum virgatum
  misc_feature: Ceres CLONE 2053296
  misc_feature: The sequence is a functional homolog of SEQ ID NO 959 in the 10/374,780 US patent application
  misc_feature: The sequence is a functional homolog of SEQ ID NO 960 in the 10/374,780 US patent application
  misc_feature: The sequence is a functional homolog of SEQ ID NO 2036 in the 10/374,780 US patent application
  misc_feature: The sequence is a functional homolog of SEQ ID NO 898 in the 11/479,226 US patent application
MALSASLVRQEVPPGRQLRNQLAAAARSINWSYALFWSISSTQPGILTWTDGFYNGEVKTMKIANSAELTAEQLVMQRSEQLRELYEALLSGDCDRRAARPVASLSLEDLGDTEWYYVVCMTYALPAWAKGCPG

SEQ ID NO: 49897 - DNA, 716 bp, Panicum virgatum
  misc_feature: Ceres CLONE 2053312
  misc_feature: Encodes the peptide sequence at SEQ ID NO. 49898
ctttgaggtttgacaaggaagggctgccttctctactcgccccagttgatttctttgtcagtacagttgatcccatgaaggaacctccgttggtcacagcaaatactgttctatctatcctggcggtggattatccagttgacaaggtttcatgctatgtttctgatgatggtgctgccatgctgacatttgaagctttgtctgaaacatctgaatttgcaaagaaatgggttcctttctgcaaaaagtacagtattgagcctcgtgctccagaatggtacttccaactgaagatagactacctgagagataaggtggctccaaacttcgttagggagcggagagcaatgaagagagagtatgaggaattcaaggttagaatcaatgccttggttgctaaagcccaaaaggttcctgaggaaggatggacaatgcaggatgggactccatggcctggaaacaatgttcgtgatcatcctggaatgattcaggtattccttggtcaaagtggtggccatgatgtggaaggaaatgagctgcctcgattggtttacgtttcaagagaaaaacggcctggctacaaccatcataagaaggctggtgctatgaatgcattggtccgagtctctgctgtactaaccaatgcaccatatatgctgaacttggattgcgatcactacatcaataacagcaaggctattaaggaagcaatgtgt

SEQ ID NO: 49898 - protein, 237 aa, Panicum virgatum
  misc_feature: Ceres CLONE 2053312
  misc_feature (1)..(237): Pfam Name: Cellulose_synt Pfam Description: Cellulose synthase
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: The sequence is a functional homolog of SEQ ID NO 6 in US patent 7285702
  misc_feature: Functional homolog of the protein sequence given in SEQ ID NO 50124
  misc_feature: Useful for making plants with altered carbohydrate content
  misc_feature: Functional homolog of the protein sequence given in SEQ ID NO 50260
  misc_feature: Useful for making plants with modulated biomass
  misc_feature: Functional homolog of the protein sequence given in SEQ ID NO 50123
  misc_feature: Useful for making plants with altered cell wall content and/or composition
  misc_feature: The sequence is a functional homolog of SEQ ID NO 2 in US patent 7049481
LRFDKEGLPSLLAPVDFFVSTVDPMKEPPLVTANTVLSILAVDYPVDKVSCYVSDDGAAMLTFEALSETSEFAKKWVPFCKKYSIEPRAPEWYFQLKIDYLRDKVAPNFVRERRAMKREYEEFKVRINALVAKAQKVPEEGWTMQDGTPWPGNNVRDHPGMIQVFLGQSGGHDVEGNELPRLVYVSREKRPGYNHHKKAGAMNALVRVSAVLTNAPYMLNLDCDHYINNSKAIKEAM

SEQ ID NO: 49899 - DNA, 325 bp, Panicum virgatum
  misc_feature: Ceres CLONE 2053363
  misc_feature: Encodes the peptide sequence at SEQ ID NO. 49900
acatacaactggcccacctcccgtccacccacctcatcccccgcacacacacacccatcgatcgaaaaaaaaagaggaaaaggctcacaccaaatccaccccccatcccttcccctccgccccgccgccgccgccgcgcagatccgccgccgccatggcgacctcccgcacctcctggcccgacgtcgccgacgccgagcccgccccgccgcctcccgcccccgcccccgcccccgcccccgcggcctccaacggccccgcccgctcctcctacgtccccccccacctccgcaacccctccgactcctccccggaggctcactcc

SEQ ID NO: 49900 - protein, 56 aa, Panicum virgatum
  misc_feature: Ceres CLONE 2053363
  misc_feature: Functional homolog of the protein sequence given in SEQ ID NO 50206
  misc_feature: Useful for making plants with altered carbohydrate content
MATSRTSWPDVADAEPAPPPPAPAPAPAPAASNGPARSSYVPPHLRNPSDSSPEAH

SEQ ID NO: 49901 - DNA, 655 bp, Panicum virgatum
  misc_feature: Ceres CLONE 2053371
  misc_feature: Encodes the peptide sequence at SEQ ID NO. 49902
tggtagagttgacgactccactggctgcgcatctgctccccgctccgctccttcccttttcagcgcccctttctctttcaccccgctccgctccttgccttgccccccgcccgcccgcccgcctaccctttcgcacccccgcctcaacgccgccgcccgccgctgccgatcgaggtactggcccccctgccatccccaccgcctcgcgcgcggtctggatctggggtttccctctttctctcgggttgatccggggggaaagagcgcggggggctggtgggtgggcaggggccgagggggttgcggatcctagggctgctgccgtgggtgtaggcgtcgaccttgctggtgccgctgctccctgctcggcgtgctgggttctgattgccgctggtcgtggctccgtgaccgaggcggagcgattggctactgtgcgctggtggagtggggaaagaaaatgttgcgaggactgatgcgacaataaagcttcctcgatggacggatgtgattgcatcgagccactatggacaacagacgatctgctcgtcaagtatcactacatctcggacttcttcatagccctcgcgtatttctcgatcccgttggagctcatctacttagtgaagaagtcgtccttcttaccgtatagatgggt

SEQ ID NO: 49902 - protein, 53 aa, Panicum virgatum
  misc_feature: Ceres CLONE 2053371
  misc_feature: SWISSPROT Homolog: EC 2.7.13.3 Histidine kinase
  misc_feature: Functional homolog of the protein sequence given in SEQ ID NO 51743
  misc_feature: Useful for making plants with modulated biomass
  misc_feature: Useful for making plants with modulated biotic stress sensitivity
  misc_feature: Useful for making plants with modulated light response
  misc_feature: Useful for making plants with modulated root development
  misc_feature: Useful for making plants with modulated salt sensitivity
  misc_feature: The sequence is a functional homolog of SEQ ID NO 6 in US patent 7105654
MDGCDCIEPLWTTDDLLVKYHYISDFFIALAYFSIPLELIYLVKKSSFLPYRW

SEQ ID NO: 49903 - DNA, 644 bp, Panicum virgatum
  misc_feature: Ceres CLONE 2053419
  misc_feature: Encodes the peptide sequence at SEQ ID NO. 49904
  misc_feature (577)..(577): n is a, c, t, g, unknown, or other
gcaaaacgcgcggcgtcgcggaacaccccgtccacccgttccattccaagtcccggctgccctctctttctgccgcggcgcctgccacctccccgccccccctcctctctccggctccacgccatcccgccccggtcgaccccgccgcctctcaccggcgatcccccctccctctccctctcgcccggccagttcacagctttctagtgttctgtggccttttgtttggtggttggtgcctctttgaagttgagtaacttctgtgagactccagtgcaatgtcaaatgcaaaagtggtacttgagcctgcgtttcaaggagttggtcataaaccagggacagaaatatggaggatcgaagattttaagccagttcctttgccaaaatcagattatggtaaattctactgtggagattcgtatatagttctgcagacgacttgtaacaaaggaggtgcttatcttcttgacatccacttctggattggaaaagattctagccaggatgaagctggaactgcagcaatcaagacaatcgagcttgacaccatgcttgggggtcgagcagtacagcacanggaaccacaaggctatgaatctgataaaatcctgtcatactttaagccatgcatcatacccatggaa

SEQ ID NO: 49904 - protein, 121 aa, Panicum virgatum
  misc_feature: Ceres CLONE 2053419
  misc_feature (28)..(111): Pfam Name: Gelsolin Pfam Description: Gelsolin repeat
  misc_feature (100)..(100): Xaa is any aa, unknown, or other
MSNAKVVLEPAFQGVGHKPGTEIWRIEDFKPVPLPKSDYGKFYCGDSYIVLQTTCNKGGAYLLDIHFWIGKDSSQDEAGTAAIKTIELDTMLGGRAVQHXEPQGYESDKILSYFKPCIIPM

SEQ ID NO: 49905 - DNA, 616 bp, Panicum virgatum
  misc_feature: Ceres CLONE 2053431
  misc_feature: Encodes the peptide sequence at SEQ ID NO. 49906
tgatgaggacccgttatcgtactcgaactcgataccttcccatccctcgccgccccgaccccgccgcccgccgcgactcccccgccgccgtcgacgcgaacacgcgtgctagacctcgttcctgtgcctcctgtggccgaggcgatgaagctcgtccaccgtgacctcgtccgcaacggccccggctccgtcaagttagtgccggaggaggaggacgacttgtggcacgcttacaacctcattgctaccggggacaatctgcaagcggtcactgttcggaaagtgctgagagaggtggcatctggagggcgtgatgctgagcgtgtgaagcttaagttggaaattgtagtagagtctgtagactatgacaaggagggatctgtcttacgtgtgcgtggaaaaaatatcactgagaatgatcatgtgaagattggccagttccacactttagagcttgagctgaagagacctttcgttctacgaaaggaaatttgggattggttagcccttgaaaccatccagcaagcatgtgatccttctgcaagtgctgatctagcagttattctcatgcaagaaggacttgcacacctgttcctcattggcagaagcataacag

SEQ ID NO: 49906 - protein, 157 aa, Panicum virgatum
  misc_feature: Ceres CLONE 2053431
  misc_feature (1)..(131): Pfam Name: eRF1_1 Pfam Description: eRF1 domain 1
MKLVHRDLVRNGPGSVKLVPEEEDDLWHAYNLIATGDNLQAVTVRKVLREVASGGRDAERVKLKLEIVVESVDYDKEGSVLRVRGKNITENDHVKIGQFHTLELELKRPFVLRKEIWDWLALETIQQACDPSASADLAVILMQEGLAHLFLIGRSIT

SEQ ID NO: 49907 - DNA, 247 bp, Panicum virgatum
  misc_feature: Ceres CLONE 2053436
  misc_feature: Encodes the peptide sequence at SEQ ID NO. 49908
ctcatccaccgtgtcctgagttcccctcctgactgccatctctgggctttgcaggatcggaggtctgagtggtctccccatctccagagatactctcggcgagaaggtcgccatggccgggaaaggagacgggccagcgatcggaatcgaccgcggcaccaccttctcgtgcgttcgggcctggcagcatgagcgcggcaatatcttcgccaacgatcatggtaagctctgcactccgtcgtacgtc

SEQ ID NO: 49908 - protein, 44 aa, Panicum virgatum
  misc_feature: Ceres CLONE 2053436
  misc_feature: Functional homolog of the protein sequence given in SEQ ID NO 50336
  misc_feature: Useful for making plants with modulated heat sensitivity
MAGKGDGPAIGIDRGTTFSCVRAWQHERGNIFANDHGKLCTPSY

SEQ ID NO: 49909 - DNA, 578 bp, Panicum virgatum
  misc_feature: Ceres CLONE 2053439
  misc_feature: Encodes the peptide sequence at SEQ ID NO. 49910
agcaagcaagcaatcgcttaaccacacagaaccttcacctcttttccttctttcttcaacctcccagacctctctctcctgtagccttttccagtcgtgcgcgccccaccaaccgcccatcttttgctcacactcttcaactcccccctccctctcagtctcagctcactgcgtgcgcacgcgcgcgtgtgtgcgtgtatatatatatctgcaagttcttgcagcggcgagctagctccgccacaatatctatatccatctacccacctacacaagatgggtaacaccgtcatgctgcgggcgttggtgctggcgctcgcggtggccgccgccgccgggaagcggcagacgtacatcgtccacatggccaagtcagcgatgccggcggcgtacgcggaccgcggcgagtggtacggcgcctcgctgcgctccgtgtccgcggccggcaagatgctgtacgcctacgacacggtcctgcacggcttctcggcgcggctcacgccggcggaggccgcgggcctggcgcgcgtggagggggtcctcgccgtcaacccggaggcgcggtacgagctgcacac

SEQ ID NO: 49910 - protein, 100 aa, Panicum virgatum
  misc_feature: Ceres CLONE 2053439
  misc_feature (24)..(100): Pfam Name: Subtilisin_N Pfam Description: Subtilisin N-terminal Region
MGNTVMLRALVLALAVAAAAGKRQTYIVHMAKSAMPAAYADRGEWYGASLRSVSAAGKMLYAYDTVLHGFSARLTPAEAAGLARVEGVLAVNPEARYELH

SEQ ID NO: 49911 - DNA, 614 bp, Panicum virgatum
  misc_feature: Ceres CLONE 2053446
  misc_feature: Encodes the peptide sequence at SEQ ID NO. 49912
aaacacttggctcacacagaaagccctccaccatctctcgcccccgccgcgtgatcgccgcgccgcccaaaagattctgcgccgggacatggggggaggcctggaggtcgacctgtcgcacggggccgtggcggcgctgtggaggtcgccgccgtcgagttggcgccccgtgctgcaggtggcggacgcgcgccatgtgccggacggcagcggcctcagcccggcgccagagcagcggtaccgcctcgacctctccgacggcgtgcacttgcagcctggcacgctcgccgcctccctgaaccacctcgtcagggacggggccctccgccggggctccgtggttcacatcctcgacttcaactgcgactaccgccgcaggaccatcgtcatcattcagttacaaatcctgcaacctgagtgtgctctgattggcagtctcaagctctatgagccaacaaggaaatcttgcgggttcagcacaagatcaattagatatgctcccaggcctgattgcgaaccttattatggaggccagcacattcaccagagtggtattgcatccgaggctgaagaaaggacatatcacgggccttttggtggatccagtctacctg

SEQ ID NO: 49912 - protein, 175 aa, Panicum virgatum
  misc_feature: Ceres CLONE 2053446
  misc_feature (8)..(109): Pfam Name: Rep-A_N Pfam Description: Replication factor-A protein 1, N-terminal domain
MGGGLEVDLSHGAVAALWRSPPSSWRPVLQVADARHVPDGSGLSPAPEQRYRLDLSDGVHLQPGTLAASLNHLVRDGALRRGSVVHILDFNCDYRRRTIVIIQLQILQPECALIGSLKLYEPTRKSCGFSTRSIRYAPRPDCEPYYGGQHIHQSGIASEAEERTYHGPFGGSSLP

SEQ ID NO: 49913 - DNA, 655 bp, Panicum virgatum
  misc_feature: Ceres CLONE 2053472
  misc_feature: Encodes the peptide sequence at SEQ ID NO. 49914
gccatgccaatataattgatcttgtcctccttccccattaagcattctttgctagctccaacaatggctgccacaatctctggcctcctggctttcctctgcctctactgctttttcgtgctttgcattcacgcaccttgtgcctcctcaacttccttcagcttcaacttttcagataccagcaaggaccccttcgccaacggtctcaagcacgcgggggacgcaaagttcactggctccatgatcgatctaacaagaaacgaccgtgctcttccaagcaacagcagccttggtcgggtgtggtacgggaacccagtgctgctctgggacgccgccaccggtgagctagcaagcttcaacaccgtcttctcctttatgatctttcaggatactcaatataagaagaatccggatgggactttcaacgctggcgatgggatggccttcttcctcgcgagctactcggacagcagcgtcctgggcaacagcggcggcgggggtgggaacctcggcctcttcaatgacaccaaccacttcaacgccaccggtgacagtcgggtcgttgccgtcgagttcgatacgttccttaatccgcaatgggataatagctctcagcacgttggcatcgacatcaactccatcatgtcggtggcgt

SEQ ID NO: 49914 - protein, 197 aa, Panicum virgatum
  misc_feature: Ceres CLONE 2053472
  misc_feature (28)..(197): Pfam Name: Lectin_legB Pfam Description: Legume lectin domain
MAATISGLLAFLCLYCFFVLCIHAPCASSTSFSFNFSDTSKDPFANGLKHAGDAKFTGSMIDLTRNDRALPSNSSLGRVWYGNPVLLWDAATGELASFNTVFSFMIFQDTQYKKNPDGTFNAGDGMAFFLASYSDSSVLGNSGGGGGNLGLFNDTNHFNATGDSRVVAVEFDTFLNPQWDNSSQHVGIDINSIMSVA

SEQ ID NO: 49915 - DNA, 618 bp, Panicum virgatum
  misc_feature: Ceres CLONE 2053519
  misc_feature: Encodes the peptide sequence at SEQ ID NO. 49916
acatactctatcccctgcctttcatcattccttcttcatctcttatcttccaaacacacatacagacacacaccaaagccgaacgggagatagatacaaagttacgaacacaaagatgaggcgtgggctaaaaggtctcaccttcctgcttctccttgtcttgcttgttctgtgctccagcattcgtctatgctatgcaagaagtgggaagcattggaggcgaagcagagcgacctccacctctatgctgagaaaagggaaaccaaagagcagcagttcccacaagcaaaacggcaaaggaaataggagtccataccagccaagtccgagcacaagccctgtcagcccgagcacaagccctgtccagagtaaaggaggccagggtccaacaatgccaacaccaggcggtggcagtggatgtacagtgccacctccaccaccgttgcagccgcctccactgccgtctccaccggcagcgcacgacacagtcttcaacgtggttgattttggagccaagggtgatggggttacggatgatactcagatatacacaggcttttgaagcagcatgggcagcagcatgcaaggtggaggcatctacggttcttataccatctg

SEQ ID NO: 49916 - protein, 148 aa, Panicum virgatum
  misc_feature: Ceres CLONE 2053519
  misc_feature: Functional homolog of the protein sequence given in SEQ ID NO 50988
  misc_feature: Useful for making plants with altered carbohydrate content
MRRGLKGLTFLLLLVLLVLCSSIRLCYARSGKHWRRSRATSTSMLRKGKPKSSSSHKQNGKGNRSPYQPSPSTSPVSPSTSPVQSKGGQGPTMPTPGGGSGCTVPPPPPLQPPPLPSPPAAHDTVFNVVDFGAKGDGVTDDTQIYTGF

SEQ ID NO: 49917 - DNA, 536 bp, Panicum virgatum
  misc_feature: Ceres CLONE 2053520
  misc_feature: Encodes the peptide sequence at SEQ ID NO. 49918
acatactctatcccctgcctttcatcattccttcttcatctcttatcttccacacacacatacagacccacaccaaagccgaacaggagatcgatacaaagttcccaacccccagatgacgcgtgggctaaaaggtctcaccctcctgcttctccttgtcttgcttgttctgtgctccagcattcgtctatgctatgcaacacgtgggaagcattggaggcgaagcacagcgacctccacctctatgctgagaaaagggaaaccaaagagcagcagttcccacgagcaaaacggcataggaaataggagtccataccactcaagtccgagcacatgccctgtcagcccaagcacaagccctgtccagagtaaaggaggccagcgtccaacaatgccaacaccaagcggtggcaatggatgtacagtgccacctccaacaccgttgcagccgcctccactgccgtctccaccggcagcgcacgacacagtcttcaacgtggttgattttggagccaagggtgatggggttacggatg

SEQ ID NO: 49918 - protein, 140 aa, Panicum virgatum
  misc_feature: Ceres CLONE 2053520
  misc_feature: Functional homolog of the protein sequence given in SEQ ID NO 50988
  misc_feature: Useful for making plants with altered carbohydrate content
MTRGLKGLTLLLLLVLLVLCSSIRLCYATRGKHWRRSTATSTSMLRKGKPKSSSSHEQNGIGNRSPYHSSPSTCPVSPSTSPVQSKGGQRPTMPTPSGGNGCTVPPPTPLQPPPLPSPPAAHDTVFNVVDFGAKGDGVTD

SEQ ID NO: 49919 - DNA, 649 bp, Panicum virgatum
  misc_feature: Ceres CLONE 2053527
  misc_feature: Encodes the peptide sequence at SEQ ID NO. 49920
actcacctcgtttcaaattttcctctgttaaaccctacccacctgaatctcccccaggcagatccagccagctcgccggaggaatccgccggaatattgcatcgagcggcggggagaggagttggaggcggaggcggcgtcgggagggttagggctgggcggggtcgtcgccgccatggaggctcaggcgacggcgacggtgaaggaggcgctcgccgcgctgtaccatcaccccgacgacagcatccgcaccgccgccgaccgctggctccaggagttccagcacacgctcgatgcctggcaggtagctgacagtttacttcatgatgaaagcagtaatttagaaactctcatcttctgttctcagaccctcagaagcaaggtacaaagggactttgaagagttacctgcgggagctttccgatcattacaggattctttatatgtgttgctgaaaaagtttaataagggaccagcaaaagttagaacacagatttgtattgcaattgctgctctggctgtgcatatacctgtagaggactggggatctggtggaattgtgaattggctaagcgatgagatgaaagctcatccagaatttatttcaggtttccttgaactgctgatagttttgccgcaggaaacttct

SEQ ID NO: 49920 - protein, 157 aa, Panicum virgatum
  misc_feature: Ceres CLONE 2053527
  misc_feature (28)..(95): Pfam Name: IBN_N Pfam Description: Importin-beta N-terminal domain
MEAQATATVKEALAALYHHPDDSIRTAADRWLQEFQHTLDAWQVADSLLHDESSNLETLIFCSQTLRSKVQRDFEELPAGAFRSLQDSLYVLLKKFNKGPAKVRTQICIAIAALAVHIPVEDWGSGGIVNWLSDEMKAHPEFISGFLELLIVLPQET

SEQ ID NO: 49921 - DNA, 709 bp, Panicum virgatum
  misc_feature: Ceres CLONE 2053529
  misc_feature: Encodes the peptide sequence at SEQ ID NO. 49922
aaaaaatttcaagactcatgcttgccttctatctaagcactactcctcctagttaattagctagtagcatctctcatctcctcctcccttcttgaggctccgatctatacagtagctagtagtcaacagtagtataaactgtgtgtagtagtagactgttgtgtagaggttgctacagagcaatccaatagctagcacatcagagctgagcagtcgccattttttatcaccatgacgagctcgactagactgcctaatcttccagctgggttccgcttccaccccacagatgaggagctcatcgtccactacctcatgaaccaagcttcctccatcccatgccctgtccccatcatcgccgaggtcaacatctaccagtgcaacccatgggatcttcctgccaaagctttgtttggagagaacgagtggtacttcttcagcccgagggatcgcaagtaccccaacggcgcccgccccaaccgcgccgccagatccggctactggaaggccaccggcaccgacaaggccatcctgttgactccgacgagcgagaacatcggagtcaagaaggcccttgtgttctacggcggtaagcctcccaagggtgtcaagacagactggatcatgcacgagtaccgcctcacaggagctaacaagaacaccaagcgtagaggatcctccatgaaggtcagataaatttctccaaata

SEQ ID NO: 49922 - protein, 154 aa, Panicum virgatum
  misc_feature: Ceres CLONE 2053529
  misc_feature (10)..(138): Pfam Name: NAM Pfam Description: No apical meristem (NAM) protein
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 854 in the 10/374,780 US patent application
  misc_feature: The sequence is a functional homolog of SEQ ID NO 851 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 1012 in the 11/435,388 US patent application
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Functional homolog of the protein sequence given in SEQ ID NO 50906
  misc_feature: Useful for making plants with modulated water use efficiency
  misc_feature: The sequence is a functional homolog of SEQ ID NO 852 in the 10/374,780 US patent application
  misc_feature: Functional homolog of the protein sequence given in SEQ ID NO 50324
  misc_feature: Useful for making plants with altered terpenoid content
  misc_feature: Functional homolog of the protein sequence given in SEQ ID NO 50326
  misc_feature: Useful for making plants with modulated light quality response
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 612 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 476 in the 10/666,642 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Functional homolog of the protein sequence given in SEQ ID NO 50732
  misc_feature: Useful for biocontainment applications
  misc_feature: Useful for making plants with modulated biomass
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 1729 in the 11/479,226 US patent application
  misc_feature: The sequence is a functional homolog of SEQ ID NO 745 in the 11/479,226 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: Functional homolog of the protein sequence given in SEQ ID NO 50907
  misc_feature: Useful for making plants with altered carbohydrate content
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 310 in the 10/666,642 US patent application
MTSSTRLPNLPAGFRFHPTDEELIVHYLMNQASSIPCPVPIIAEVNIYQCNPWDLPAKALFGENEWYFFSPRDRKYPNGARPNRAARSGYWKATGTDKAILLTPTSENIGVKKALVFYGGKPPKGVKTDWIMHEYRLTGANKNTKRRGSSMKVR

SEQ ID NO: 49923 - DNA, 603 bp, Panicum virgatum
  misc_feature: Ceres CLONE 2053547
  misc_feature: Encodes the peptide sequence at SEQ ID NO. 49924
gatcccctcccttctcttcccgatcattccattccggctttccccaacccttcgaccacccgaggaagaaaagaagttgaagcatggggaagagaaagtcagctgctaagccacctcctaagaagcggatggacaagcttgacactgtcttttcctgcccattctgcaatcatgggagcagtgttgagtgccgtattgacatgaagaatttgattggcgaggcttcttgcagaatctgtcaggaaaacttcagcaccactgttaatgcactcactgagcctattgacatatatagtgaatggattgatgagtgtgagcgtgtcaacactgttgaaggtgatgatgatgcatgagctccccccatgctgatggaacggttactggcaactgtattgtactggcatgcttggatgccatagtcagccatggcttgtaatggcgctgtaagggcatattggctgcctgatacgccgttaggcggtatcagtttatctagtacttaataaactctaaaaaaatacgtgtatgccaactagtgactgcctacaatgatataacaggttttctgtgagtaaaaaaaccccccccccacacgcgagcctc

SEQ ID NO: 49924 - protein, 89 aa, Panicum virgatum; identical to SEQ ID NO: 27831
  misc_feature: Ceres CLONE 2053547
  misc_feature (8)..(68): Pfam Name: Elf1 Pfam Description: Transcription elongation factor Elf1 like

SEQ ID NO: 49925 - DNA, 708 bp, Panicum virgatum
  misc_feature: Ceres CLONE 2053568
  misc_feature: Encodes the peptide sequence at SEQ ID NO. 49926
ccaaaaaaaaaacttgcccttcttcttccttgaaggcttggtcctcctccttgtatctccaccccacagatccgccgccgccacctctagctagggttgttaggtttcctctgcagcgatggcgatcaagcggaccaaggcggagaagaagcaggcgtacgaccgcaagctgtgcagcctgctcgatgagtacaccaaggtgctcatcgccctcgccgacaacgtcggctccaagcagctccaggacatccgccgcgggctgaggggcgactccgtggtgctcatggggaagaacacgctcatcaggcgctgcatcaaggcctacgccgacaagactgggaaccacaccttcgacccgctcatggacctgcttgtcggcaacgtcggcctcatcttcaccaagggagacctcaaggaggtccgcgaggaggtggccaagtacaaggttggtgctcctgctcgtgttgggctggttgctccagttgatgtcgttgtcccccctggcaacactggcctggatccctcccagacctctttcttccaggtgctcaacatccccacaaagattaacaagggtactgtggaaattattacccctgtggagctgatcaagaagggtgacaaagtgggctcatctgagtctgctcttctcgccaagctgggtatccgcccgttctcgtatggtctccagatcaccaatgtctatga

SEQ ID NO: 49926 - protein, 196 aa, Panicum virgatum
  misc_feature: Ceres CLONE 2053568
  misc_feature: SWISSPROT Homolog: EC 4.2.99.18 DNA-(apurinic or apyrimidinic site) lyase
MAIKRTKAEKKQAYDRKLCSLLDEYTKVLIALADNVGSKQLQDIRRGLRGDSVVLMGKNTLIRRCIKAYADKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLQITNVY

SEQ ID NO: 49927 - DNA, 560 bp, Panicum virgatum
  misc_feature: Ceres CLONE 2053577
  misc_feature: Encodes the peptide sequence at SEQ ID NO. 49928
gtagaaaatcttaggaatccttattacattgttgacaaaggataaggaagatatggctaggctgttgaaagataaggaagaaataataagactgatgaaagagaaggaagaaatggttacgctgattaaggagaaggaagatattggtaccttgaaggccaaggttgatgacagggatcaatcagcagatgtacatgtagctaaatcaatcacatatagcagagaaatatttaggatgatgaaggagaaagaagaaagtaatcttacaaatatgaaattaaaacacgaattagaagctgtaaaattatcgtatgaagagagtcagagcttgttaaaatctacaaaggaagacatgcgtaagcttctaaaggacaaggagaattgtgagattataatatcaaaactcaggcaagagcttgcagtagcaggaaaatctcataagagacatattcaagaactggagggtagagctttgcaggcaaatgaagagttcaaacagagaattaaagaagtagagctcatgctcgaagattctagaatgaaaggaagagatcttgagg

SEQ ID NO: 49928 - protein, 169 aa, Panicum virgatum
  misc_feature: Ceres CLONE 2053577
  misc_feature: SWISSPROT Homolog: EC 2.7.11.1 Non-specific serine/threonine protein kinase
MARLLKDKEEIIRLMKEKEEMVTLIKEKEDIGTLKAKVDDRDQSADVHVAKSITYSREIFRMMKEKEESNLTNMKLKHELEAVKLSYEESQSLLKSTKEDMRKLLKDKENCEIIISKLRQELAVAGKSHKRHIQELEGRALQANEEFKQRIKEVELMLEDSRMKGRDLE

SEQ ID NO: 49929 - DNA, 692 bp, Panicum virgatum
  misc_feature: Ceres CLONE 2053583
  misc_feature: Encodes the peptide sequence at SEQ ID NO. 49930
gctcttatttggtctcccacggcgattcgaaacaaattcttttccccgaagaaaggaaaggaaggagacggccggcgagctaatcggccatgggggacagccagtactccttctccctcaccaccttcagcccgtctggtaagctggtgcagatcgagcacgcgctgacggcggtgggctctggacagacctccctcgggatcaaagctgctaatggagttgttattgccactgagaagaaactgccgtctaatttagtggatgaaacatctgtgcaaaagattcaagcgttgactccaaatattggagttgtttacagtgggatgggtccagattttcgcgttcttgtgaggaaaagccggaagcaagcacagcagtattaccgattgtacaaggtatttgtgatagttcatttggtgtacattatctttttatttaaatatcttgacgcaaaaatatccttatgaaagtatatgcaatatatttacttggtgattctgttaaaacgacctattactatacttaagtgttgtacctcatgtctgtttaatatcgtacaagtaaatatctttgaatctgtaggaggtcaagacaactgagatggcatatcaagtttccaaaagtttaaaaatcattgttgttgttttttctagttggtgaggcccattaatatgagcaatatacccatcaaa

SEQ ID NO: 49930 - protein, 125 aa, Panicum virgatum
  misc_feature: Ceres CLONE 2053583
  misc_feature: SWISSPROT Homolog: EC 3.4.25.1 Proteasome endopeptidase complex
MGDSQYSFSLTTFSPSGKLVQIEHALTAVGSGQTSLGIKAANGVVIATEKKLPSNLVDETSVQKIQALTPNIGVVYSGMGPDFRVLVRKSRKQAQQYYRLYKVFVIVHLVYIIFLFKYLDAKISL

SEQ ID NO: 49931 - DNA, 562 bp, Panicum virgatum
  misc_feature: Ceres CLONE 2053616
  misc_feature: Encodes the peptide sequence at SEQ ID NO. 49932
gtgctcctcccctcctctgcttccctcccccaaccgccgcacctcccctccgccgctcccgtccctccggccacttcattgtccctgaattgggccctaacaccaagttctcctactcttctcacaaggctgttaatgaatacaaggaggctaaggcgcttggcgttgataccgtgccagttttcattggaccagtctcgtacttgttgctctcgaagcctgccaagggagtagaaaagggtttccctcttctttcccttcttagcagcatccttcctgtctacaaggaggtcattgctgagttgaaggcagctggggcttcatggattcagttcgatgagcccacccttgtccttgaccttgatgctcacaaattggctgcattctctgctgcatacacagagcttgagtctgcactttctggactgaatgtgctcgttgagacttactttgctgatgttcctgcagaatcattcaagaccctaacatctttgagcagtgtgactgcttatgggtttgaccttgttcgtggaacccagactgttgagcttatcaagagtgg

SEQ ID NO: 49932 - protein, 186 aa, Panicum virgatum
  misc_feature: Ceres CLONE 2053616
  misc_feature (1)..(186): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
APPLLCFPPPTAAPPLRRSRPSGHFIVPELGPNTKFSYSSHKAVNEYKEAKALGVDTVPVFIGPVSYLLLSKPAKGVEKGFPLLSLLSSILPVYKEVIAELKAAGASWIQFDEPTLVLDLDAHKLAAFSAAYTELESALSGLNVLVETYFADVPAESFKTLTSLSSVTAYGFDLVRGTQTVELIKS

SEQ ID NO: 49933 - DNA, 688 bp, Panicum virgatum
  misc_feature: Ceres CLONE 2053621
  misc_feature: Encodes the peptide sequence at SEQ ID NO. 49934
gacttgactccgccgcggattccccgccagatctcgttccgcccccaaccctaaccgccgggggtggccatgatggccaccgagcccttgtccccggggaagccccccgccgccgacgacctcgaaaccctacccctcgactcctcctcctccagtgtcgcggccacgaccgaccccttgctccgcccgcctccttccccctcgtccgccacctcctctcccaccgccggcacgaaccacggcccgttcgtggacgaggacgaggacgaggaggacggcgatgcggatggcgtcactccagcgcccgctccccgcagcgcggcgacgccccgcgaggcgtccccggtgttcgctgagatcactgtctccgagcctaggaagcacgcggagcccgccacgggagccgtgggcgtcattcccggctcggccagctacgtgtcctaccttgtcgccacccgggcgtccgacggcggcgaattccgcgtgcggcggcgcttccgcgacgtcgtggcgctcgccgaccgcctcgcggaggcccaccgcggcctcttcgtccccgcgcggcccgacaagagcatcgtagaggggcaggtcatgcagcggcacgacttcgtgaaccagcggtgcgtcacgatccagcgctacctccgccgcctcgccgcgcaccccgtcgtcggccgcagcgccc

SEQ ID NO: 49934 - protein, 206 aa, Panicum virgatum
  misc_feature: Ceres CLONE 2053621
  misc_feature (92)..(206): Pfam Name: PX Pfam Description: PX domain
MMATEPLSPGKPPAADDLETLPLDSSSSSVAATTDPLLRPPPSPSSATSSPTAGTNHGPFVDEDEDEEDGDADGVTPAPAPRSAATPREASPVFAEITVSEPRKHAEPATGAVGVIPGSASYVSYLVATRASDGGEFRVRRRFRDVVALADRLAEAHRGLFVPARPDKSIVEGQVMQRHDFVNQRCVTIQRYLRRLAAHPVVGRSA

SEQ ID NO: 49935 - DNA, 514 bp, Panicum virgatum
  misc_feature: Ceres CLONE 2053630
  misc_feature: Encodes the peptide sequence at SEQ ID NO. 49936
gcctcggtcacgacgcgcagtcgcccgcccattccgcatctcgccctcccggcctccgattggccgccgcccccccccccccccccccagtggactctccggttgtttgatttgatttgacgagatgcctgcgctcgccgtcgacgccgcgacacctgtggcgcacgccttcgcgtcctgcgacgcggcgcgcttcccggccgccccgctcatggccgaaaagcccgaggcggccgcgtggtcgcccgacctctccgccgcgctctacaacgtcgacgggtggggcgccccctacttcttcgtaaacgaagacggcgacgtcgccgtgcgcccgcacggcgccgccacgctgcccggccaggatatcgacctggccaaggtcgtcgccaaggccgcgggcccgcgcgaggccggtggcctcggcctgcccgtgcccctgctcgtgcgcttccccgacgtgctgcgccaccgcgtcgagaccctcaacgccgccttcgactacgccgtccgctcc

SEQ ID NO: 49936 - protein, 129 aa, Panicum virgatum
  misc_feature: Ceres CLONE 2053630
  misc_feature: SWISSPROT Homolog: EC 4.1.1.19 Arginine decarboxylase
MPALAVDAATPVAHAFASCDAARFPAAPLMAEKPEAAAWSPDLSAALYNVDGWGAPYFFVNEDGDVAVRPHGAATLPGQDIDLAKVVAKAAGPREAGGLGLPVPLLVRFPDVLRHRVETLNAAFDYAVR

SEQ ID NO: 49937 - DNA, 455 bp, Panicum virgatum
  misc_feature: Ceres CLONE 2053633
  misc_feature: Encodes the peptide sequence at SEQ ID NO. 49938
ccgcaatccctccctcctccatcatccatccagatcgcggcagccgcctgcctgaccagacattctcctcctcgggacgggcgacgaccagccggccatgaccccccgcggcgcgccggctctgctggttctggcgctgctcgggctcctgctgcacccgcgcccggcggcggcgcagcatgagggcgccgtgccggaggcgtacgcagcctcgttcgcgttccgcttcgccgcgccgccgtcctggtccttcccgaacccgcgcctccgcgccgcctacgccgcgctccaggcctggaagagcaccgccatcttctccgaccccaccaacttcaccgccaactggtccggccccgacgtctgcgcctacaacggcgtcttctgcgcgcccctccccggcggcgccgccgggtacggccacggccacagcggcgatggcaacctcgtcgtcgccg

SEQ ID NO: 49938 - protein, 119 aa, Panicum virgatum
  misc_feature: Ceres CLONE 2053633
  misc_feature: SWISSPROT Homolog: EC 2.7.11.1 Non-specific serine/threonine protein kinase
MTPRGAPALLVLALLGLLLHPRPAAAQHEGAVPEAYAASFAFRFAAPPSWSFPNPRLRAAYAALQAWKSTAIFSDPTNFTANWSGPDVCAYNGVFCAPLPGGAAGYGHGHSGDGNLVVA

SEQ ID NO: 49939 - DNA, 585 bp, Panicum virgatum
  misc_feature: Ceres CLONE 2053655
  misc_feature: Encodes the peptide sequence at SEQ ID NO. 49940
accacctctctctctctctctctctctctagtctctgcgcgaggagtacgcgtcactgcgccgcacatagagagggagatcgccgctgcgccggggagatgagatgagaggagccgtgttcctggcggtcctcgtcgccgccgcggcggcggcggcggcgggggaggggcggccggcggcggtggaggtggacccgaggtggggggtcgcgaggcggcggctgcgggacgcgggcgtcgcgctgcagacgtggaagcgggaggccatcttctccgacccccggaacctcacggccgactgggtggggcccggggtctgcaactacacgggcgtctactgcgcgccgctcccctcggccccccgcggggagctcgccgtcgccggggtcgacctcaaccacggcgacatcgcggggttcctcccgccggagctgggcctcctcgccgacctcgcgctgctccacctcaactccaaccgcttctgcggcgtcctcccgcccgcgctgcgccgcctccgcctcctccacgagctcgacctcagcaacaaccgcttcgtcggcccgttcccggacgtcgtcctcgacct

SEQ ID NO: 49940 - protein, 160 aa, Panicum virgatum
  misc_feature: Ceres CLONE 2053655
  misc_feature: SWISSPROT Homolog: EC 2.7.11.1 Non-specific serine/threonine protein kinase
MRGAVFLAVLVAAAAAAAAGEGRPAAVEVDPRWGVARRRLRDAGVALQTWKREAIFSDPRNLTADWVGPGVCNYTGVYCAPLPSAPRGELAVAGVDLNHGDIAGFLPPELGLLADLALLHLNSNRFCGVLPPALRRLRLLHELDLSNNRFVGPFPDVVLD

SEQ ID NO: 49941 - DNA, 452 bp, Panicum virgatum
  misc_feature: Ceres CLONE 2053661
  misc_feature: Encodes the peptide sequence at SEQ ID NO. 49942
acacactctgcctcgactcactcgagcgctctccactctcacacgccccgagttccgatcacctcgcttcgcggccgcggccgcggccgcgccccaaaccccgcaaaaccctaaccggccagccccacgccggccaccgccaccgccaccgccatgccgaccgctccccaccgcctcgctgccttcctcccgctcctgctcctcctggcctccgcgccccgccccgcggcccccgcctccaccgaccgcgcggcgctcctcgccttccgcgccgccctcgcgccgccctcccgcgccgcgctcgcctcctggcgcggcccgctctcgccgtcctggcgcggcgtctcgctccacccggacgccgtgcccgcgcccgggcccgccgccgctccctccgtcgccgagctcatgctccgggggctcaacctcacaggcgcgatcacggccgtagc

SEQ ID NO: 49942 - protein, 99 aa, Panicum virgatum
  misc_feature: Ceres CLONE 2053661
  misc_feature: Functional homolog of the protein sequence given in SEQ ID NO 51590
  misc_feature: Useful for making plants with modulated yield
MPTAPHRLAAFLPLLLLLASAPRPAAPASTDRAALLAFRAALAPPSRAALASWRGPLSPSWRGVSLHPDAVPAPGPAAAPSVAELMLRGLNLTGAITAV

SEQ ID NO: 49943 - DNA, 728 bp, Panicum virgatum
  misc_feature: Ceres CLONE 2053673
  misc_feature: Encodes the peptide sequence at SEQ ID NO. 49944
atcgacagggcatcagtgcgagcttcttctcaactcggtccaagaactctacgctttccagctcccttgtctaggctttgacgccatcctaagagatggaggcaaatccgaagaacatcttcacaattaaagtggaagatgggaagcccagcaaggacggccacccagcggtagggccagtgttccggagcgtgctggccaaggatggattcccacagcttgagcctgacatgaaaacatcatgggatgtgttcagggtagcagcagacaagtatcccaacaaccggatgcttgggtggcgtccacttaaagatggagtgccagggccctacttgtggaaatcatacaaggaggtctacgatgaagtgctgcaagttggttctgcattgcagcagctcggagtgcaaccaggttccagggtcggaatctatggatccaattgccctcagtggatagtggcaatgcaggcttgcaatggctacagtctaatctgtgtcccactatacgatactttaggtgcaggagctgttgactacattattgatcatgctgagattgatgttgtcttcatacaggacaagaaaataaaagagatactatccccaaattgcaagtctgctaagaggctaaaaggtaagcaaaggcaatagggcccatttgtaatttggaaagactatagtttcaaacatcactatctaaatatggatacagcattggtggcattcact

SEQ ID NO: 49944 - protein, 184 aa, Panicum virgatum
  misc_feature: Ceres CLONE 2053673
  misc_feature: SWISSPROT Homolog: EC 6.2.1.3 Long-chain-fatty-acid--CoA ligase
MEANPKNIFTIKVEDGKPSKDGHPAVGPVFRSVLAKDGFPQLEPDMKTSWDVFRVAADKYPNNRMLGWRPLKDGVPGPYLWKSYKEVYDEVLQVGSALQQLGVQPGSRVGIYGSNCPQWIVAMQACNGYSLICVPLYDTLGAGAVDYIIDHAEIDVVFIQDKKIKEILSPNCKSAKRLKGKQRQ

SEQ ID NO: 49945 - DNA, 683 bp, Panicum virgatum
  misc_feature: Ceres CLONE 2053743
  misc_feature: Encodes the peptide sequence at SEQ ID NO. 49946
atcgacctcagctttgcattgtctgagctgaacttttagcgagagcagtgcgtgccgtggcagccatgacgctgttggagttcgccctcgccgcgcctcatctcgccttcttcgggcaccgggccgctgctcctcgacctcgatcgggagtcgcgcggctgccgccgcagagccaccgctgtcgccgcaagccgcttctggcggtgcagtcgcgcacgcggccgaccggctcacccgccgcaagccgcggcgccgcgggagtgctggagcggggaactaagcaaaaggacaggacggtagcgatcagggagcggctcctgagcggcgaggcgccgctgccatcggcgtacgacacggcgtgggtcgcgatggttccggcgccggcgccggcggggtccgctccggcgccgcgctacccggggtgcgtggactgggtcctgcggagccagcgacgggacgacgggtcgtgggggcccagcgacccctcgctgcgcaaggacgcgctctcgtccacgctggcgtgcgtgctcgccctccggaagtggggcgccggcggcgacgccatcgagagagggctccgtttcatcgggcgcaactggtcctgcgtgacggacgacagctgcgacgcgccggccgggttcgacatcatcttccccggcatgctcgcgcgtgctatcggcatg

SEQ ID NO: 49946 - protein, 205 aa, Panicum virgatum
  misc_feature: Ceres CLONE 2053743
  misc_feature: SWISSPROT Homolog: EC 4.2.3.19 Ent-kaurene synthase
MTLLEFALAAPHLAFFGHRAAAPRPRSGVARLPPQSHRCRRKPLLAVQSRTRPTGSPAASRGAAGVLERGTKQKDRTVAIRERLLSGEAPLPSAYDTAWVAMVPAPAPAGSAPAPRYPGCVDWVLRSQRRDDGSWGPSDPSLRKDALSSTLACVLALRKWGAGGDAIERGLRFIGRNWSCVTDDSCDAPAGFDIIFPGMLARAIG

SEQ ID NO: 49947 - DNA, 647 bp, Panicum virgatum
  misc_feature: Ceres CLONE 2053767
  misc_feature: Encodes the peptide sequence at SEQ ID NO. 49948
cttcccgagacagccgctcctccgccggcctcctcctcccacctcctcgcggcgcggccatccatcccacccccggaacacacccccgaccactggcacctcgcgccacgcccccccgaccaccgccaccgccgcctttgactcgttgaccgacaagtgtgagcgccgccggccatggatgcgcgccgcaagctggggcagcagggcgccgccgcggtgccggcggcggcggcccggctgccgagggtgcaggccggggacgcgctgccgctgccgatccggcacaccaacctcatcttctcggccctgttcgcggtctcgctcgcctacctgatgcgccgctggcgcgagaagatccgcagctccacgccgctccacgccgtggggctcgccgagatgctcgccatcttcgggctcatcgcctcgctcatctacctcctcagtttcttcggcatcgccttcgtgcagtccatcgtctcctccagcgacgaggacgaggacttcctcggcgtcggggccggggctccggcgccccccgccccgtgcgcgctgctggggagccccgccgccgcgcccgagaaaatgccggaggaggacgaggagatcgtcgccgcggtcgtcgccggggagatcccgtcctacgtgct

SEQ ID NO: 49948 - protein, 157 aa, Panicum virgatum
  misc_feature: Ceres CLONE 2053767
  misc_feature: SWISSPROT Homolog: EC 1.1.1.34 Hydroxymethylglutaryl-CoA reductase (NADPH)
MDARRKLGQQGAAAVPAAAARLPRVQAGDALPLPIRHTNLIFSALFAVSLAYLMRRWREKIRSSTPLHAVGLAEMLAIFGLIASLIYLLSFFGIAFVQSIVSSSDEDEDFLGVGAGAPAPPAPCALLGSPAAAPEKMPEEDEEIVAAVVAGEIPSYV

SEQ ID NO: 49949 - DNA, 704 bp, Panicum virgatum
  misc_feature: Ceres CLONE 2053797
  misc_feature: Encodes the peptide sequence at SEQ ID NO. 49950
acactaccaatcccggactcccatttgcttcccacgcggctacggcttctcccttttccgcagcggtgtgccccacaccacacccgcacgctgcccccgttccgccgccgctgtgtcaccaccatgccgtcgccgcccggcggccagtgaagagagacacggacacacgacgcgccgcggggagtgggagggcgatgaagcctccgccgcagggccggggcgggagcggcggcgcgctgggccggcgggcgttcgcgtccctcctcgcggcggccatcatcgcgctcgcgctcctctgcctcttccacggcgccgccttcggcccctccatccgccgccgtccccaccacaccggcctccccgtccgccggctcggattccgggcccggatgacgacggaggcgctcccggccgacatcgtcctctcctccgtcccggtgtgcgacgcgaggcattcggagctgatcccgtgcttggaccgcgcgctccactaccggctccggctccggctcaacctctccctcatggagcactacgagcgccattgcccgaccgcgccgcaccgcctcaactgcctcatcccaccgcccgacggctaccaggtgcccatcaggtggccgaggagcagggacgaggtgtggaaggccaacataccccacccgcaccttgctgccgagaaatcggaccagcggtggatggtagtc

SEQ ID NO: 49950 - protein, 169 aa, Panicum virgatum
  misc_feature: Ceres CLONE 2053797
  misc_feature: The sequence is a functional homolog of SEQ ID NO 1236 in the 11/479,226 US patent application
  misc_feature: Functional homolog of the protein sequence given in SEQ ID NO 51755
  misc_feature: Useful for making plants with altered cell wall content and/or composition
MKPPPQGRGGSGGALGRRAFASLLAAAIIALALLCLFHGAAFGPSIRRRPHHTGLPVRRLGFRARMTTEALPADIVLSSVPVCDARHSELIPCLDRALHYRLRLRLNLSLMEHYERHCPTAPHRLNCLIPPPDGYQVPIRWPRSRDEVWKANIPHPHLAAEKSDQRWMV

SEQ ID NO: 49951 - DNA, 712 bp, Panicum virgatum
  misc_feature: Ceres CLONE 2053809
  misc_feature: Encodes the peptide sequence at SEQ ID NO. 49952
acacccacgcacatctcacgactcgatggagctcggcctcgtcatggatatccccctcccgttcctgctctccacctttgctgtgtctgcaaccgtatgctaccttctcttcttcctttcggggaaggcggcagggaggccgcgtacaccgctgccgccgggccctaggggctggcccgtgctggggaacctgccgcagctcggcgggaagacccaccaaaaattgcacgagatgaccaaggtgtacggcccgctactccggctgcggttcggcagctccaacgtggtggtggccggttccgccgcagtggcggagcagtttctccgcgtccacgacgccaacttcagctgccggccgcccaactccggcggcgagcacatggcgtacaactaccaggacgttgtattcgcgccctacggcccacgctggcgcgccatgcggaaggtgtgcgccgtgaacctcttctctacccgcgcgctcgacgatctccgggatgtgcgggaaagggaggcagcacacatggtgaggtcgctcgtggaggcgaccaccagtccggctgtggcgctcggcaggctggtgaacgtctgcacgacaaacgctttgtcacgggcggcggtcggattgcgcgtgttcgcggacggcaacgagggtgctagggattcaaggagatcgtgctggaggtaatggaagtgggcggcgtgcctcacgtcg

SEQ ID NO: 49952 - protein, 219 aa, Panicum virgatum
  misc_feature: Ceres CLONE 2053809
  misc_feature: SWISSPROT Homolog: EC 1.14.13.21 Flavonoid 3'-monooxygenase
MELGLVMDIPLPFLLSTFAVSATVCYLLFFLSGKAAGRPRTPLPPGPRGWPVLGNLPQLGGKTHQKLHEMTKVYGPLLRLRFGSSNVVVAGSAAVAEQFLRVHDANFSCRPPNSGGEHMAYNYQDVVFAPYGPRWRAMRKVCAVNLFSTRALDDLRDVREREAAHMVRSLVEATTSPAVALGRLVNVCTTNALSRAAVGLRVFADGNEGARDSRRSCWR

SEQ ID NO: 49953 - DNA, 746 bp, Panicum virgatum
  misc_feature: Ceres CLONE 2053814
  misc_feature: Encodes the peptide sequence at SEQ ID NO. 49954
atcgacactctccccgcaccaccaccaccaccaccacccccgccgctgcggctcacggctacgcagcccgctcacccgctccctctccctcccctctctccggttgcttcgagggttcgccccgaatcgatcgcccgactgaccccgctagggttcggcccgatcgcccgccgcttcgtcctccccgcgggggttttccccggacgcgatgtcggaccggagctcgccggtcgcgccgacgttcttccccttcggcccgcaggccgatgcgtgggacgtcacgttcaaggtcaaatatggtgacacacttaagaggttttatggttgtgtcaatggagctcattttgacatgaatttatctgctctatgggcaaagatagccactgcctttaagtttggtccagatgccgacttcattctgacttacatcgatgaggatggtgatgctgtaatgctagatgatgatgatgacctgcgcgatgcagctctgcgtcagaaactaaaccctctgaggattactgttcaaccaaagaaaagtcaaccaactgaacaaaaggagaaaaattctactacacctatgaagtccactcctcaggatccactgtcccagattatttcagctattgaaggtttgaagcctgctcaggaagaaagcttggcacatataaaatcagctattggtgaagctttcagtctatcccagagccaattcctgatgcccttgcaaaactctctcatgaagtact

SEQ ID NO: 49954 - protein, 179 aa, Panicum virgatum
  misc_feature: Ceres CLONE 2053814
  misc_feature (23)..(108): Pfam Name: PB1 Pfam Description: PB1 domain
MSDRSSPVAPTFFPFGPQADAWDVTFKVKYGDTLKRFYGCVNGAHFDMNLSALWAKIATAFKFGPDADFILTYIDEDGDAVMLDDDDDLRDAALRQKLNPLRITVQPKKSQPTEQKEKNSTTPMKSTPQDPLSQIISAIEGLKPAQEESLAHIKSAIGEAFSLSQSQFLMPLQNSLMKY

SEQ ID NO: 49955 - DNA, 668 bp, Panicum virgatum
  misc_feature: Ceres CLONE 2053841
  misc_feature: Encodes the peptide sequence at SEQ ID NO. 49956
attcctcccccctctcttcttcaatcctccctgcgccggagttggagggagaggggagaagctcttgccgctcgccgacccgcccgcctgccgatttggtgaatcaaacacacacatatctaagagaaccccttcaaacaggagtttgtacagcgtattagataattctgtcacagcatgacctcggcaggcgtgttgcgcccttctgtgggatttcagaacgacacaagttctagtagtgatgcagaacgactctggaatgagatgggcaatatgagcataagggatgataaggacattgaagatatagtagtcaatggcaatggaaccgagcctggtcatattatagtgacaaacattgatgggagaaatgggcaggaaaaacagaccattagttacatggccgagcgtgtggtagggcatgggtccttcggaactgttttccaggccaagtgtctggagactggcgagactgtagctatcaaaaaggttcttcaggacaagagatataagaaccgtgagctgcaaacaatgcgagtgcttgaccacccaaatgtggtgtctctaaagcactgtttcttctcaaagactgagaaggaggagctttatctcaatctggtgcttgagtatgtgccggagactgctcaccgtgtcattaaacattataa

SEQ ID NO: 49956 - protein, 163 aa, Panicum virgatum
  misc_feature: Ceres CLONE 2053841
  misc_feature: SWISSPROT Homolog: EC 2.7.11.1 Non-specific serine/threonine protein kinase
  misc_feature: Functional homolog of the protein sequence given in SEQ ID NO 50366
  misc_feature: Useful for making plants with modulated water use efficiency
  misc_feature: Functional homolog of the protein sequence given in SEQ ID NO 50365
  misc_feature: Useful for making plants with modulated biomass
MTSAGVLRPSVGFQNDTSSSSDAERLWNEMGNMSIRDDKDIEDIVVNGNGTEPGHIIVTNIDGRNGQEKQTISYMAERVVGHGSFGTVFQAKCLETGETVAIKKVLQDKRYKNRELQTMRVLDHPNVVSLKHCFFSKTEKEELYLNLVLEYVPETAHRVIKHY

SEQ ID NO: 49957 - DNA, 649 bp, Panicum virgatum
  misc_feature: Ceres CLONE 2053843
  misc_feature: Encodes the peptide sequence at SEQ ID NO. 49958
  misc_feature (348)..(348): n is a, c, t, g, unknown, or other
acttccaccgcgccgcggtctccactccttcatcctcccctccaccgccaccaatcccaaccctaatccacgcgcaacaaaccctagctccgagatccacccacttcctacgcatgccgcgcttcctccggtggctgcaccggccgagctaagccagacagccggtccccactcgccgccgcggccgccgttgcagttgcagccgccgccatgggctgcgtctgcggccgcccctcctcagccttcgacgacggccagtgccgcacaacgcctccgccggccgcgaagctctcggcggcggtgaggagggaggaggaggcgcggaagcagcagcagcatgccaggggnggtagcgggagggaggaggcgctggagaggaggcgggcgatgatggcgatggcggcggcgtgccaggtcaggagcccggtgcccagggtagttgagggagagcaggtggccgcggggtggccgccgtggctcgtcgccgtcgccccggaggccgtgcgcggatgggtgccgcgccgcgccgaatcgttcgagaagctcgacaagattggtcagggtacatacagtaatgtttacagagctcgtgatctcgaaaaagagaagattgttgctttgaagaaagtacgatttgataatttggaac

SEQ ID NO: 49958 - protein, 146 aa, Panicum virgatum
  misc_feature: Ceres CLONE 2053843
  misc_feature: SWISSPROT Homolog: EC 2.7.11.22 Cyclin-dependent kinase
MGCVCGRPSSAFDDGQCRTTPPPAAKLSAAVRREEEARKQQQHARGGSGREEALERRRAMMAMAAACQVRSPVPRVVEGEQVAAGWPPWLVAVAPEAVRGWVPRRAESFEKLDKIGQGTYSNVYRARDLEKEKIVALKKVRFDNLE

SEQ ID NO: 49959 - DNA, 718 bp, Panicum virgatum
  misc_feature: Ceres CLONE 2053846
  misc_feature: Encodes the peptide sequence at SEQ ID NO. 49960
gccatcgccactcttaccctcactcgctcactaacaatgtggcgccatggcgagagatgcgtgatctttgctgtggccgccgcggccctgttggcggcggcggccgccgccgcgctcccgacgtacacgagcggtggagctacatcgtccgcgtgtgcgtgtgggccagggcgaaggagttcggggaggatggggaatggtgcgccgcggcggtgcaggcggtgtcggaggcggccaccgtgctctacacctacgacacgctcgtccacggctactcggcgcggctgacgcgcgccgaggccgaggcgctggagtcgcagcccggcgtcctcatcgtcaacccggaggtgcggtacgagctgcacaccacccggacgccggagttcctggggctcgacggcacggacgcgctgttcccgcagtcgagcaccgggagtgacgtcatcatcggggtgctcgacaccggcgtgtggccggagaggccgagctacgacgacacggggttcggccccgtgccggcgggctggaagggcgagtgcgagaagggaaacgacttcagcgcctccgcgtgcaacaagaagctcatcggcgcgaggttcttcctgacgggctacgaggccgccaagggccccgtggacacgtccaaggagtcgcggtcgccgagggacaacgacggccacgggacgcacacctccagcacggcggccggcgccgccat

SEQ ID NO: 49960 - protein, 220 aa, Panicum virgatum
  misc_feature: Ceres CLONE 2053846
  misc_feature (27)..(103): Pfam Name: Subtilisin_N Pfam Description: Subtilisin N-terminal Region
  misc_feature: SWISSPROT Homolog: EC 3.4.21.25 Cucumisin
  misc_feature: Functional homolog of the protein sequence given in SEQ ID NO 51144
  misc_feature: Useful for making plants with modulated flowering time
MRDLCCGRRGPVGGGGRRRAPDVHERWSYIVRVCVWARAKEFGEDGEWCAAAVQAVSEAATVLYTYDTLVHGYSARLTRAEAEALESQPGVLIVNPEVRYELHTTRTPEFLGLDGTDALFPQSSTGSDVIIGVLDTGVWPERPSYDDTGFGPVPAGWKGECEKGNDFSASACNKKLIGARFFLTGYEAAKGPVDTSKESRSPRDNDGHGTHTSSTAAGAA

SEQ ID NO: 49961 - DNA, 684 bp, Panicum virgatum
  misc_feature: Ceres CLONE 2053852
  misc_feature: Encodes the peptide sequence at SEQ ID NO. 49962
aaaacccctcctcgcgggagcctaatccattcttttccggaggccggagcacgcggtcgcccacgcgcgcctgcaactgcaatgcatcaccccgccgatggatcgacggaacggaacgccccctctgctgtgacgtgccccgctcgccgcgcccgcgcgctccgcgttgcggcctcgccgcccacgcgccccgccatttaaatgcgctttagttcgatccatcttcttctcaaagtgccctcccctccgattctccagttcccttatcctctcccatggccgccagcctcgcgccgtcgtcgtcggcgccgctgagcctccaccgccgccggcgcggagccggaatcctcacctgccgcgccacggccacgttccaccaacttgacgccgtcgcggtgagggaggaggaggcgaagttcaagtcttcggcgaaggagggatgcaacctgctgccgttgaagcggtgcatcttctccgaccacctgacgccggtgctcgcgtaccggtgcctcgtcaaggaggacgaccgcgaggcgcccagcttcctcttcgagtccgtcgagcagggctccgagggcgagggcaccaatgtggggtggtacagtgtcgtaggggcgcagcccgccatggagatcgtggccaaggcccaccacgtgaccgtgatggatcatgagatgaagtcga

SEQ ID NO: 49962 - protein, 136 aa, Panicum virgatum
  misc_feature: Ceres CLONE 2053852
  misc_feature: SWISSPROT Homolog: EC 4.1.3.27 Anthranilate synthase
MAASLAPSSSAPLSLHRRRRGAGILTCRATATFHQLDAVAVREEEAKFKSSAKEGCNLLPLKRCIFSDHLTPVLAYRCLVKEDDREAPSFLFESVEQGSEGEGTNVGWYSVVGAQPAMEIVAKAHHVTVMDHEMKS

SEQ ID NO: 49963 - DNA, 505 bp, Panicum virgatum
  misc_feature: Ceres CLONE 2053856
  misc_feature: Encodes the peptide sequence at SEQ ID NO. 49964
acaaaagccagccaaacaatcattcgagtagaagtaaccaacccagccaagaggcagctacgactctccactgtgactccggcaacaggaggaacatgtactatggcacaccattctatggaggatacggctacgcctccccggtgccgcacccaaacatgtatgcccctgcatatggtgcgtacccgttctatggcggcaaccagcagctggtgagctagatatgagctagagagcctctctcggttccgtcccctccgacgggaaacaaggttttcgtccggtgagcgtagtagcgtcaggtgagaaggaggtatagccttataggttgtcctaaaaagtgggcgagatatgttgttgaacggatggtatggtgcctgtagttgtgtgtgcgcgtcgcaggaactggatggaactcgtggcttgtagtacaccagcgagtcgtgtcggtattctttcaagaaattttgactttgtaataaattaaactattgtttgtgcgtcc

SEQ ID NO: 49964 - protein, 72 aa, Panicum virgatum
  misc_feature: Ceres CLONE 2053856
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
KSQPNNHSSRSNQPSQEAATTLHCDSGNRRNMYYGTPFYGGYGYASPVPHPNMYAPAYGAYPFYGGNQQLVS

SEQ ID NO: 49965 - DNA, 540 bp, Panicum virgatum
  misc_feature: Ceres CLONE 2053899
  misc_feature: Encodes the peptide sequence at SEQ ID NO. 49966
accgatacctcaccactcccctcccccctcctgctcgatcgccatggacgccggtggcctcgcggcggggtcgcacatgcggggcgagctgcacgtcgtgcgcggccgcgacgcggaggccgcccggagcggcgcggacgtgaggacgtgccgcgtgtgcggggacgaggtcggggcgcgggaggacgggcagcccttcgtggcgtgcgccgagtgcggcttccccgtgtgccggccctgctacgagtacgagcgcagcgacggcacgcagcgctgcccgcagtgcaacacccgctacaagcgccagaaagggtgcccgagggtggaaggggacgaggacgacgggccggagatggacgacctggaggaggagttccccgccgccgagagccccggcaagaagccccacgaggccgtcgccttcgatgtctactcggagaacggggagcagccgccgcagaggtggtggacgggaggccagacgctctcctccttcaccggaagcgtggccggcaaggacctgcaggccgagagggagat

SEQ ID NO: 49966 - protein, 165 aa, Panicum virgatum
  misc_feature: Ceres CLONE 2053899
  misc_feature: SWISSPROT Homolog: EC 2.4.1.12 Cellulose synthase (UDP-forming)
  misc_feature: Functional homolog of the protein sequence given in SEQ ID NO 51500
  misc_feature: Useful for making plants with altered cell wall content and/or composition
  misc_feature: Useful for making plants with modulated biomass
MDAGGLAAGSHMRGELHVVRGRDAEAARSGADVRTCRVCGDEVGAREDGQPFVACAECGFPVCRPCYEYERSDGTQRCPQCNTRYKRQKGCPRVEGDEDDGPEMDDLEEEFPAAESPGKKPHEAVAFDVYSENGEQPPQRWWTGGQTLSSFTGSVAGKDLQAERE

SEQ ID NO: 49967 - DNA, 696 bp, Panicum virgatum
  misc_feature: Ceres CLONE 2053914
  misc_feature: Encodes the peptide sequence at SEQ ID NO. 49968
catcccaacaaggcacaagccgccccgtctccgttccttcgagcccaatccttcgcctcgcactgctcaaaaaaaaaaaaaaaatccttcgcctcgcagaagagggaagccgccccgccccgccgcgtctcgcttccatccccatcacaccagcagcgcgagcatccccccgattacagctgcgtctccctcctccgctccgtcgcctctcggccggcccttccaagaagcctggtcgcatctcggcgccgccgccggccgcattcttgaacgaacttttaggaagggacaatttgtggatgctctaatggagtcaaaaggtggcaagaagtctagtagtagtaatttgatgtacgaagctccccttggttacaaaattgaggacgttcgcccagccggaggaatcaagaagttccagtctgctgcttactccaactgcgtccgcaagccatcctgatatcccttcacatgcaattcgcagtagagtaggattttccttcaaattttctctctttgataattctcccttggctggctgcattctctgcttctgagattccaactcgtcttctcccatctctccctccctttcccatcctcccttgcaacacatcatctaatggcgatgccttcggctgattcttggggctcttctcctgcctcccctattgggtttgagggctacgagaagcgcct

SEQ ID NO: 49968 - protein, 49 aa, Panicum virgatum
  misc_feature: Ceres CLONE 2053914
  misc_feature (1)..(49): Pfam Name: AdoMetDC_leader Pfam Description: S-adenosyl-l-methionine decarboxylase leader peptide
MESKGGKKSSSSNLMYEAPLGYKIEDVRPAGGIKKFQSAAYSNCVRKPS

SEQ ID NO: 49969 - DNA, 685 bp, Panicum virgatum
  misc_feature: Ceres CLONE 2053924
  misc_feature: Encodes the peptide sequence at SEQ ID NO. 49970
tcttcccggcccaaactcccgccgcctccaacccaaactactcgagtagccgctcggcgcgcacctctccggcaagtagcgacggaaagaagagagcctgccgctgccgcggagccatcgccgcaccaccgcctcccgatccgccgccctcctgcagccacaggccaccggataacgcgcggccaaccttccaaggacgcgcggcaactccccgcccttcccatcaagaacccacccgaatcccccccgcggccccgcctccgcgtgccaatcaccaccaacccaccagtagcacagcagcagctcactctcgcctcgcctccgcggcaggaggagccatgcagcccgacgccatcgcccccttgcaccgcctcgcccgcgtcgccgcgcacctcaacccgcagatggaggagggcgcggtggcgctgaggcccgcggcgtgccgcgccaagggcggcgcgcctgggttcaaggtcgccatcctgggcgcggcgggcgggatcggccagccgctgtctatgctcatgaagatgaacccgctcgtgtccgtgctgcacctctacgatgtcgtcaacacgcccggggtcaccgccgatatcagccacatggacaccggcgccgtggtaacattttcgtcccccatctttctcgctcgatctgtgtcactttgcagagtgatgcctac

SEQ ID NO: 49970 - protein, 115 aa, Panicum virgatum
  misc_feature: Ceres CLONE 2053924
  misc_feature (44)..(111): Pfam Name: Ldh_1_N Pfam Description: lactate/malate dehydrogenase, NAD binding domain
  misc_feature: SWISSPROT Homolog: EC 1.1.1.37 Malate dehydrogenase
MQPDAIAPLHRLARVAAHLNPQMEEGAVALRPAACRAKGGAPGFKVAILGAAGGIGQPLSMLMKMNPLVSVLHLYDVVNTPGVTADISHMDTGAVVTFSSPIFLARSVSLCRVMP

SEQ ID NO: 49971 - DNA, 648 bp, Panicum virgatum
  misc_feature: Ceres CLONE 2053935
  misc_feature: Encodes the peptide sequence at SEQ ID NO. 49972
acccattgccatcctcattccctctccctcctctctagtctctctctctctctctctctctctctctctttttgaagagaatctctctctctccccaccaccaccaccaccacggcaccacccctcacaagaagaagcagaaggccatggagctggacgagcaggccttcctggaggagatcctctccctgcggagggatgcctgggactgcaatgccatgggcgacttcttctccccggcggcgcgttcggcgccggcgccgcgccgccggccccggcgtccaagaagaagcgggtggagggcatgccgtccaagaacctgatggccgagcgccgccgccgcaagcgcctcaacgaccgcctctccatgctgcgctccgtcgtgcccaagatcagcaagatggacaggacatcgatcctgggcgacacgatcgactacatgaaggaactgctggagaggatcaagctgctgcaggaggagatcgacgagcagcagcaggagacgccgggcgtgctgagcgtgttccgggagctcaaccccaacgagatggtggccaggaacacccccaagttcgacgtggagcgcaaggagagcggcgagacccgggtggagatctactgtgccgccaagcccgggctgctgctgtc

SEQ ID NO: 49972 - protein, 114 aa, Panicum virgatum
  misc_feature: Ceres CLONE 2053935
  misc_feature (3)..(50): Pfam Name: HLH Pfam Description: Helix-loop-helix DNA-binding domain
  misc_feature: Functional homolog of the protein sequence given in SEQ ID NO 51091
  misc_feature: Useful for making plants with altered lignin content
MPSKNLMAERRRRKRLNDRLSMLRSVVPKISKMDRTSILGDTIDYMKELLERIKLLQEEIDEQQQETPGVLSVFRELNPNEMVARNTPKFDVERKESGETRVEIYCAAKPGLLL

SEQ ID NO: 49973 - DNA, 700 bp, Panicum virgatum
  misc_feature: Ceres CLONE 2053938
  misc_feature: Encodes the peptide sequence at SEQ ID NO. 49974
gagtgcagcagcaaatcctgggccaggccggggtcgaggacggagccaaccgtccgttccggcactagctttggggatgggtgcccggaccggaatggcggcgaagcggctcctgtccgctgtgctcctcgtcgcagctctcgcctgcgacggcacgcatgccaagttcagcaggcacagcttccccaaggacttcatcttcggcaccggctccgcggcgtaccagtacgagggagcatacaaggaaggaggcaaagggcttagcatatgggacaagttcacccacatcccaggaaaaatcttgaacaatgataacggcgacgtggcacttgacatgtaccatcgatacaagggggatgtgcaattcctaaaggacatgaacatggactccttccggttctccattgcttggaccaggatcctgccaagtgagcacacctgaacatggactacaaaatcgatttttagacaaggataaaacaccattggtaggagcgggtggggtacccacgactacatcaggataacgtgcccgttccttaaaaatcaattttgagaaaataaaaaatgaaaatgacaaaataaaagggaataaatatatcccaaccaaccaaccacaacctcctctgctatagaggtacaattttttagcgaaatatgcacacttgtatcaaccggagttcgaaccacttgcatcaag

SEQ ID NO: 49974 - protein, 121 aa, Panicum virgatum
  misc_feature: Ceres CLONE 2053938
  misc_feature: SWISSPROT Homolog: EC 3.2.1.21 Beta-glucosidase
  misc_feature: Functional homolog of the protein sequence given in SEQ ID NO 50295
  misc_feature: Useful for making plants with altered carbohydrate content
  misc_feature: Functional homolog of the protein sequence given in SEQ ID NO 50615
  misc_feature: Useful for making plants with modulated biomass
  misc_feature: Functional homolog of the protein sequence given in SEQ ID NO 50359
  misc_feature: Useful for making plants with altered cell wall content and/or composition
  misc_feature: Functional homolog of the protein sequence given in SEQ ID NO 50360
  misc_feature: Useful for making plants with modulated flowering time
MGARTGMAAKRLLSAVLLVAALACDGTHAKFSRHSFPKDFIFGTGSAAYQYEGAYKEGGKGLSIWDKFTHIPGKILNNDNGDVALDMYHRYKGDVQFLKDMNMDSFRFSIAWTRILPSEHT

SEQ ID NO: 49975 - DNA, 549 bp, Panicum virgatum
  misc_feature: Ceres CLONE 2054044
  misc_feature: Encodes the peptide sequence at SEQ ID NO. 49976
caattcctccgcttctcgatttcacagcagcctttgcagccgagctcaatcgtctgcctcccttgttggttggttggttggttggttttcgcctccgatccaaaggcaagagagccatggcgctgatgacgctgcgttccaccacgtcgttcctgtcgcccgtcgaccccagctccaagctcctccacaagcccggcgccgacgacgcgccgccgagctgcgccgccgtgcccgccccgccgcacgccgccgcgccgagccgcaggctgcgcctcgtcagggcgggcgccgccgcggcgcccgcgccggcggcggaccgcgcgccggccggggccgccgccgagctgctgcacgccggcggcgcgggccaggagcacgggcgcgcgcgcggcggggtccccgtctacgtgatgctgccgctggacacggtggggcccggcggccagctgtcgcggcagcgcgcggtggcggcgagtctgatggcgctgcggggcgccggggtggagggcgtcatggtggacgtctggtggggcgtcgtggagcgggagg

SEQ ID NO: 49976 - protein, 144 aa, Panicum virgatum
  misc_feature: Ceres CLONE 2054044
  misc_feature: SWISSPROT Homolog: EC 3.2.1.2 Beta-amylase
MALMTLRSTTSFLSPVDPSSKLLHKPGADDAPPSCAAVPAPPHAAAPSRRLRLVRAGAAAAPAPAADRAPAGAAAELLHAGGAGQEHGRARGGVPVYVMLPLDTVGPGGQLSRQRAVAASLMALRGAGVEGVMVDVWWGVVERE

SEQ ID NO: 49977 - DNA, 557 bp, Panicum virgatum
  misc_feature: Ceres CLONE 2054064
  misc_feature: Encodes the peptide sequence at SEQ ID NO. 49978
acttgaaatgctattgtggaagaatgtggttagggaacctgtcgtgaagccagcttatcaatcagaacttattttgataatttgagtgcttgttttgtacatacttttctcttttgcttcattccccccaatgctattgattgcagtaagtatcagtataagggaaagcagaagaacatggcggtcacacagtttgaggctgtgcatgcccggcgttgcttcccatgctgggatgagcctgcattcaaggctaagttcaagctaactcttgaagtgccatctgagctggtagcgctgtccaatatgccagtagctgatcaaacaattgctggtcctatcaagactgtccattatgagaaatcaccccttatgtcaacttatttagtggcaatcgttgttggcttgtttgattatatagagggtgtgacatcagaaggtaccaaagtacgtgtgtacactcaagttggtaatagtaatcaaggaaagtttgcactagatgttggtttgaagtcactgagtctctataaacattacttcggcacaccttatcccctgcc

SEQ ID NO: 49978 - protein, 126 aa, Panicum virgatum
  misc_feature: Ceres CLONE 2054064
  misc_feature: SWISSPROT Homolog: EC 3.4.11.2 Membrane alanyl aminopeptidase
MAVTQFEAVHARRCFPCWDEPAFKAKFKLTLEVPSELVALSNMPVADQTIAGPIKTVHYEKSPLMSTYLVAIVVGLFDYIEGVTSEGTKVRVYTQVGNSNQGKFALDVGLKSLSLYKHYFGTPYPL

SEQ ID NO: 49979 - DNA, 670 bp, Panicum virgatum
  misc_feature: Ceres CLONE 2054165
  misc_feature: Encodes the peptide sequence at SEQ ID NO. 49980
cttccgtttgctatctcctcttcttcgcccccccccccctctctcgcccccctcgccgtgcccacgcgactgcgcgagacactggtcaacggccgggtagcaggcggcgcccgttgggggtgggtctagctccgtcgatcgccccggaggaacgcggcgcggtgctgcctccggcgcgcgggttttcccatggggaggaacgggagcgtgaagcgctcggggtccactggcggctcgggggccgccgccgcggggccgccgacgttcaccgtgaaccccggcgactaccggctgatggaggaggttgggtacggcgcgcacgccgtcgtgttccgcgcgatcttcctgcccagggacgaggtcgtggcggtcaagtgcctggatctcgatcagctgaataacaacatcgatgaaatacaaagggaggctcaaataatgagcttgatcgatcatcctaatgtcatcagggcttactgctcatttgttgtggagcacagcctttgggtgataatgccattcatgacagagggttcatgtttacacttaatgaagatctcataccaggatggtttcgatgagccagtcatcggttccatcctaaaggaaactcttaaggctctggaataccttcacaggcaaggtcaaatacatcgtgatgtcaaggctgggt

SEQ ID NO: 49980 - protein, 160 aa, Panicum virgatum
  misc_feature: Ceres CLONE 2054165
  misc_feature (33)..(160): Pfam Name: Pkinase_Tyr Pfam Description: Protein tyrosine kinase
  misc_feature: SWISSPROT Homolog: EC 2.7.11.1 Non-specific serine/threonine protein kinase
MGRNGSVKRSGSTGGSGAAAAGPPTFTVNPGDYRLMEEVGYGAHAVVFRAIFLPRDEVVAVKCLDLDQLNNNIDEIQREAQIMSLIDHPNVIRAYCSFVVEHSLWVIMPFMTEGSCLHLMKISYQDGFDEPVIGSILKETLKALEYLHRQGQIHRDVKAG

SEQ ID NO: 49981 - DNA, 544 bp, Panicum virgatum
  misc_feature: Ceres CLONE 2054201
  misc_feature: Encodes the peptide sequence at SEQ ID NO. 49982
aaaaaaaaaaaaaaaaaaaatccatagttgactttgttgcaaagatttgggtctgtccattctgctttcagcgcaaccacttcccccaacattactcctctatttcagaaaacaacctccctgccgaactgtttccacagtataccaccgttgagtatgcatccactgctgaaatgggtcctgtggcgcctcctgtcttcctctttgttgttgatacatgtatgattgaggaggagattggatatttgaagtctgctttagcacaagctattgaactattgccagatcaatcccttgttggatttattacttttgggacatatgtgcaggtgcatgagttgggttttggcttgttgccaaagtcatatgtgttcaaagggaccaaagaagtgacaaaggaggaaattctggaccaaatgagcttctttgccgggaaaactaaacccacaacaggtgtgatcgctggtgcaagggacggcctttcaacaaagagcattgctaggttcctgctgcctgcttctgagtgcgagtttgtgttgaattc

SEQ ID NO: 49982 - protein, 180 aa, Panicum virgatum
  misc_feature: Ceres CLONE 2054201
  misc_feature (61)..(180): Pfam Name: Sec23_trunk Pfam Description: Sec23/Sec24 trunk domain
KKKKKKSIVDFVAKIWVCPFCFQRNHFPQHYSSISENNLPAELFPQYTTVEYASTAEMGPVAPPVFLFVVDTCMIEEEIGYLKSALAQAIELLPDQSLVGFITFGTYVQVHELGFGLLPKSYVFKGTKEVTKEEILDQMSFFAGKTKPTTGVIAGARDGLSTKSIARFLLPASECEFVLN

SEQ ID NO: 49983 - DNA, 677 bp, Panicum virgatum
  misc_feature: Ceres CLONE 2054222
  misc_feature: Encodes the peptide sequence at SEQ ID NO. 49984
agaacgccctctcctcgccgtctccagcacgcccagatctccttccacaccaaaccgcagctggcagtcggcgatcggatccgccggcagccatggcgttcgattccttcaccgacaagaacgccgtcttccgccgcctcaaggccaagccggagaacaagatgtgcttcgactgcaacgccaagaaccccacctgggcctccgtcacctacggcatcttcctctgcctcgactgctccgccgtccaccgcagcctcggagtccacatcaccttcgtcaggtcaacaaaccttgactcatggaccccagatcagctgaagatgatggcttttggaggcaacaatagggcacatgctttcttcaaacagcatggatggactgatggcggcaaagtcgaggccaagtacacatcaagagctgctgagttgtacaggcagatactttcaaaggaggtcgctaagagcgccacaactgacagtgccttgccgtcatcaccggttgcgtctgagacacccaagccatccgatgacttccctgaattcaagctttcagatccaccggcagagaattcgaatgggaagcaggaacccaagtcgccaaaagcgcctcctcgttcaccaaaagcccctactcatcccacctttgccacttccgtaaagaagcccattggcgcaaag

SEQ ID NO: 49984 - protein, 194 aa, Panicum virgatum
  misc_feature: Ceres CLONE 2054222
  misc_feature (10)..(126): Pfam Name: ArfGap Pfam Description: Putative GTPase activating protein for Arf
MAFDSFTDKNAVFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQILSKEVAKSATTDSALPSSPVASETPKPSDDFPEFKLSDPPAENSNGKQEPKSPKAPPRSPKAPTHPTFATSVKKPIGA

SEQ ID NO: 49985 - DNA, 614 bp, Panicum virgatum
  misc_feature: Ceres CLONE 2054245
  misc_feature: Encodes the peptide sequence at SEQ ID NO. 49986
ggaggaacctcacgctaagccgcctcctagccctaaacccttccgtcccgatggcgtcctccccgccgccgccgccgaagctgccgatccccggccgccgcaacatactcatcaccagcgcgcttccgtatgtgaataatgtcccccacctcgggaacatcatcggctgtgtgctcagcgccgatgtgttcgcgcggtactgccggctccgcggttacaacgccatctacatatgcggtactgatgagtacggcacggccaccgagacaaaggccatggaggaaaagtgcacgcccaaggagatctgcgacaagtaccatgctattcatagtgaagtttacaaggggtttaacataaaatttgacaagttcggacgcacatcctctcctgagcaaacagaagtctgccatgcaattttccataaattaatggaaaacaattggctcacagaaaatactatgcagcagctttactgtgatacatgtcaaagatttttggctgatcggcttgtggaaggaacatgcccaaacaaagtctgcaatgcagcagcacgtggagatcaatgtgaaacatgcagcaccttgttgaatccaaccgaactgattgacccgaag

SEQ ID NO: 49986 - protein, 187 aa, Panicum virgatum
  misc_feature: Ceres CLONE 2054245
  misc_feature (19)..(187): Pfam Name: tRNA-synt_1g Pfam Description: tRNA synthetases class I (M)
  misc_feature: SWISSPROT Homolog: EC 6.1.1.10 Methionine--tRNA ligase
MASSPPPPPKLPIPGRRNILITSALPYVNNVPHLGNIIGCVLSADVFARYCRLRGYNAIYICGTDEYGTATETKAMEEKCTPKEICDKYHAIHSEVYKGFNIKFDKFGRTSSPEQTEVCHAIFHKLMENNWLTENTMQQLYCDTCQRFLADRLVEGTCPNKVCNAAARGDQCETCSTLLNPTELIDP

SEQ ID NO: 49987 - DNA, 642 bp, Panicum virgatum
  misc_feature: Ceres CLONE 2054272
  misc_feature: Encodes the peptide sequence at SEQ ID NO. 49988
aagggcagcagtgctgggcagccgcatccgcctccaccgcagcgagcgcatcaaggcggagctgcaggggcaggggccgaggctggcggcgctccaccaaatcgatcgatccatcgactagattgatatatagatagatgctccgccgagatttcatggcgccgccgccgtgcccccgcatcccgccgtcctgaccccaaccgcgtcccctgtgggaaggcgagcgaaaacctcagccgcaccaaccaccagagcaacaggatggccgacagcggcggtctcagcgccaacaacgccgccgccgcccacgacgacgacgacgccaacgccgcacctttccccgacaccgtccaggtcggaggatcccccgagtacaaggtcgacaggaagctgggcaaaggtggctttggccatgtctttcttggccgacgcctaactgctgcacgctcctcggcttccgctgcccaagaggttgccatcaaatttgagcacactaccagcaagggctgtagctacggccctccgtatgaatggcaagtctacacagctctgggtggcacgcatggcgtgcccaaggtgcattataaaagccgccagggtgactactatgtcatgattatggatatgctggggcctagcttg

SEQ ID NO: 49988 - protein, 126 aa, Panicum virgatum
  misc_feature: Ceres CLONE 2054272
  misc_feature: SWISSPROT Homolog: EC 2.7.11.1 Non-specific serine/threonine protein kinase
MADSGGLSANNAAAAHDDDDANAAPFPDTVQVGGSPEYKVDRKLGKGGFGHVFLGRRLTAARSSASAAQEVAIKFEHTTSKGCSYGPPYEWQVYTALGGTHGVPKVHYKSRQGDYYVMIMDMLGPS

SEQ ID NO: 49989 - DNA, 609 bp, Panicum virgatum
  misc_feature: Ceres CLONE 2054278
  misc_feature: Encodes the peptide sequence at SEQ ID NO. 49990
gtccctccctccccagccgcggttgacgagcggcgcgtgattatttatcgagcgcggcatcaccgctgcccctttctccgcccccaccgcgcaccgccccgaccaggcacgggaaccacgccgcccctcctccccctccctctcctccccgcggacgccgccgttccctgctgacctgacctgacctgacccactgccctccgcttccgcctccaacgcccgccttcgcctcgtgctaggggagagagaccaggggcctcctcgagtccccgccgacagctcccgccgcctccaggtccaggtggatcccatccgccgaccctcccaagcaaagaggggctagctcagctccctgatctgagctgaaattaggatctgaacagtccgggccagctgatgtacggctcgccggtgtccaaggacctcaacctcccggtgcagccgccgatggcctcgtccgggctgctgaggtacagatcggcgcccagctcggtgctcggcgagctctgcgaggacttcctcccggccggggcccgcgccgccagccccgacgccggcgccgacggcgtcttcgccaggttcctggccgaccaccacatccgggacgaa

SEQ ID NO: 49990 - protein, 70 aa, Panicum virgatum
  misc_feature: Ceres CLONE 2054278
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
MYGSPVSKDLNLPVQPPMASSGLLRYRSAPSSVLGELCEDFLPAGARAASPDAGADGVFARFLADHHIRD

SEQ ID NO: 49991 - DNA, 678 bp, Panicum virgatum
  misc_feature: Ceres CLONE 2054330
  misc_feature: Encodes the peptide sequence at SEQ ID NO. 49992
acccgaaggaacgcaccaaaacaaaccactcggagctcaccaccccattccgttccctgaccaaaacccccaaaccccaccccagccaagccgccaagcccaagcccccccatggcggcgccgaccccgaccaccgccgccgccacccaccaccgcatcctcctcccgtccccgttcccgtccccgcgcggcgccctcgcgcctgccttcctccgcctgccccaccgcgagcaggcccacgcccgcgcccagcgcgcgcgcctccccgcgcccctcgcggccgcggcccccaccgcatcccccgaggcgccggcctcgggggccgtcccggggaagcccacggtgctcgtcgccgagaagctcggcgccgcggggctcgcgctgctgcgcgagttcgccaacgtcgactgctcctacggcctctcccccgaggagctccgcgccaagatctcgctctgcgacgcgctcatcgtcaggtccgggaccaaggtcggccgcgacgtcttcgaggcctccgggggcaggctccgcgtcgtcggccgcgcgggggtcgggatcgacaacgtcgacctcgccgccgccaccgagcacggctgcctcgtcgtcaacgcgcccaccgcaaacaccgtcgccgccgcggagcatggcatcgcgctgctcaccgccatggcgaggaac

SEQ ID NO: 49992 - protein, 188 aa, Panicum virgatum
  misc_feature: Ceres CLONE 2054330
  misc_feature (78)..(187): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
MAAPTPTTAAATHHRILLPSPFPSPRGALAPAFLRLPHREQAHARAQRARLPAPLAAAAPTASPEAPASGAVPGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLTAMAR

SEQ ID NO: 49993 - DNA, 728 bp, Panicum virgatum
  misc_feature: Ceres CLONE 2054425
  misc_feature: Encodes the peptide sequence at SEQ ID NO. 49994
  misc_feature (647)..(647): n is a, c, t, g, unknown, or other
gagatgaggtctcaggaccctcctcatctggctcgtccccttttccaagaacccaaggtgaatgcagactttcttttccttcaaatcgcagtttttcattttggttactcttcaaatcgattgatgctctaaaggaaacctcaatctttcaacttctgtcgaagtgaacttgtatatatctgagggttgaaacttcttagtttagttctaagttattataaattccttcgactactatgggcgggatccagcagctttatgaggtctgtaaaggatcattatctgaaaagggacctatatcttctgaagccatcgataaagtccgtgttgtattagacaagatcacaccttgtgatgttggactagagtgtgaagctcaagctgcacgtgtttggcagagtccacaaacccggagtaggaaaagagtttttccttccagccctgcgatcagataccgccacatttatgagtgcaaaagcttctcaattgggatattctgcataccagcatcgtccatcattccactccacaaccatcctggaatgactgtacttagcaaagttttatatggcacactgcatgtcaaagcatatgactggattgataacgctgaacctcttagcttattaaaagtgaaacctgcgaangttgtaagagatggtgaaatgtcggcgccttgtgcggccatggttcttcatccagaagaaggggggaacatacatgctttc

SEQ ID NO: 49994 - protein, 163 aa, Panicum virgatum
  misc_feature: Ceres CLONE 2054425
  misc_feature: SWISSPROT Homolog: EC 1.13.11.19 Cysteamine dioxygenase
  misc_feature (137)..(137): Xaa is any aa, unknown, or other
MGGIQQLYEVCKGSLSEKGPISSEAIDKVRVVLDKITPCDVGLECEAQAARVWQSPQTRSRKRVFPSSPAIRYRHIYECKSFSIGIFCIPASSIIPLHNHPGMTVLSKVLYGTLHVKAYDWIDNAEPLSLLKVKPAXVVRDGEMSAPCAAMVLHPEEGGNIHA

SEQ ID NO: 49995 - DNA, 645 bp, Panicum virgatum
  misc_feature: Ceres CLONE 2054458
  misc_feature: Encodes the peptide sequence at SEQ ID NO. 49996
atcccccattccgcccgcgcaaaaccctagctccagcgcccccgcgaaccctccccctcgcagccgccgccacctctccgccatgccggacctcccctgcgacggcgatggcgtctgcatggtctgccgcgccgcctccccgcccgaggtcgacctgctccgctgctccacctgcgccaccccgtggcactccccgtgcctctccaagccccccgccctcgccgacgccgccagctggagctgccccgactgctgccccgactcctccccggccccggctcccgccggccccgggaacgacctcgtcgccgccatccgcgccatcgaggccgaccagaccctctccgaccaggagaaagcgcggcgccgccaggccctcctcgccggctccgcccccgcggccgccgatgacgacgaagacgacaacgcggcggacgacgccctcgagatcgtggggaagaacttcagctgcgtcttttgtatgaagcttcctgaacgtcccgtcacgacgccttgtggccataacttctgcttgaaatgcttccagaagtggattcagaatgggaaaaggacgtgtggaaaatgtcgggcgcagatcccggccaaaatggctgagcaaccaagaattaactctgcactagttga

SEQ ID NO: 49996 - protein, 187 aa, Panicum virgatum
  misc_feature: Ceres CLONE 2054458
  misc_feature (130)..(168): Pfam Name: zf-C3HC4 Pfam Description: Zinc finger, C3HC4 type (RING finger)
  misc_feature (11)..(60): Pfam Name: PHD Pfam Description: PHD-finger
  misc_feature: The sequence is a functional homolog of SEQ ID NO 2314 in the 10/374,780 US patent application
  misc_feature: The sequence is a functional homolog of SEQ ID NO 522 in the 10/225,066 US patent application
MPDLPCDGDGVCMVCRAASPPEVDLLRCSTCATPWHSPCLSKPPALADAASWSCPDCCPDSSPAPAPAGPGNDLVAAIRAIEADQTLSDQEKARRRQALLAGSAPAAADDDEDDNAADDALEIVGKNFSCVFCMKLPERPVTTPCGHNFCLKCFQKWIQNGKRTCGKCRAQIPAKMAEQPRINSALV

SEQ ID NO: 49997 - DNA, 660 bp, Panicum virgatum
  misc_feature: Ceres CLONE 2054470
  misc_feature: Encodes the peptide sequence at SEQ ID NO. 49998
acttcgacacgagttcgacttcggcggaagcggaggcagccgccgccgccaccgccgccgccctaacaagcgcacaacttcatctgcggttcctctaggttttcagcatgatttatcgtgctcatagttttgagttactgaaggcatgtattgaagacatactctctacaataaaaccaggggaagatgatcgaaagaaacgattatgtgcaattcaggagctggcagattccatttactcagttggggccttgagaggtgctgttgtcaaaccttttggatccttcatatcaaatctttatgcaaagtcaggtgatttggatgtttcagttgatctctggagcagttcaagaatccctataagcaagcaaaagaagcaaaatgcattgagagaactgaagagagctttacaaattagaggtgttgctagatatatggagttcattcctaatgcaagggttccaataattcagtacatgagcaaccaatatgacatttcctgtgatatatcaattaacaactaccctggtcggatgaaatccagaatcttctactggatcaacaccatagatgagcgctttggtgatatggttttattggtcaaggaatgggcaaaaactcaaaatattaacgacccaaaaaatggaaccctgaactcat

SEQ ID NO: 49998 - protein, 184 aa, Panicum virgatum
  misc_feature: Ceres CLONE 2054470
  misc_feature: SWISSPROT Homolog: EC 2.7.7.19 Polynucleotide adenylyltransferase
MIYRAHSFELLKACIEDILSTIKPGEDDRKKRLCAIQELADSIYSVGALRGAVVKPFGSFISNLYAKSGDLDVSVDLWSSSRIPISKQKKQNALRELKRALQIRGVARYMEFIPNARVPIIQYMSNQYDISCDISINNYPGRMKSRIFYWINTIDERFGDMVLLVKEWAKTQNINDPKNGTLNS

SEQ ID NO: 49999 - DNA, 647 bp, Panicum virgatum
  misc_feature: Ceres CLONE 2054476
  misc_feature: Encodes the peptide sequence at SEQ ID NO. 50000
aatccaaaccaaacctaacccgctgctccactgccaggtgccaacttcctctccaatcctcgctctcgcggactcctctcatcggggggccggcttcggcgactaagccgcgatggactcgaggccccgcgagaccgacgcccccggcgacccggccaacggcgccgcccctccgccggccgcggcggtggcggctgctgcgacggggggcgtcgagatcaccaagccccgcaacgacaagcgcgggtaccgccgcgtggtgctccccaacgcgctcgagtgcctgctcatcagcgaccccgacaccgacaaggcggcggcgtcgatgagtgtttcggtggggtacttctgcgaccccgatggtctggaggggctcgcccacttcctcggtcagtgctctgtttcggcttgctgcatctcaactcgcttactcgcttagtgtactgcatctggagttgttttgcttcagcttgattttgatttttttcttcttctagattttcgcctgattgttcgtgaatgtctccaatccaacgtgagaaatacgtgaatgctaatgttttctttctgtttccgtggtgctctctggatactttaggtccttttggcagagatgcctcaaagtggggtcgcagagatccacccca

SEQ ID NO: 50000 - protein, 108 aa, Panicum virgatum
  misc_feature: Ceres CLONE 2054476
  misc_feature (36)..(91): SWISSPROT Homolog: EC 3.4.24.56 Insulysin
  misc_feature (65)..(92): SWISSPROT Homolog: EC 3.4.24.61 Nardilysin
MDSRPRETDAPGDPANGAAPPPAAAVAAAATGGVEITKPRNDKRGYRRVVLPNALECLLISDPDTDKAAASMSVSVGYFCDPDGLEGLAHFLGQCSVSACCISTRLLA

SEQ ID NO: 50001 - DNA, 656 bp, Panicum virgatum
  misc_feature: Ceres CLONE 2054478
  misc_feature: Encodes the peptide sequence at SEQ ID NO. 50002
gccctctctctctctctctctctctcctcgggaggcttctccctcctctccttcgccaatcgcccccattgcctttgggctatatagggagggattggattggaaaaggagctcccggcgaatttgaacccatccaaaacctcatctttctctcgtctcccccacgcgcttcccgccgccgccgccgccgacgccgccgccgccgtataggatcaaatgcggcgagatctgtgcgcgtgacgccgtctgctccctctgagtttcggaacagggagcgcctggttcaggtcttcaagatctctccggtggttaaggactgtaggacataagcttactttgagtgagctgcagactaccgaaggatggatcagtatgaggtattggagcagattggaaaaggagcatttggttctgcactgttggtgaggcacaaggtggagaagaagaagtatgtgctcaagaagattcgacttgcacgacaaacggaccgaactcgcaggtctgcacatcaggagatgcagcttattgcaacagtcaggaatccatttatcgtggagtacaaagattcatgggtggaaaagggttgctatgtttgcattgttataggttactgtgagggaggagacatggctgatgctatcaaaagagccaacagt

SEQ ID NO: 50002 - protein, 97 aa, Panicum virgatum
  misc_feature: Ceres CLONE 2054478
  misc_feature: SWISSPROT Homolog: EC 2.7.11.1 Non-specific serine/threonine protein kinase
MDQYEVLEQIGKGAFGSALLVRHKVEKKKYVLKKIRLARQTDRTRRSAHQEMQLIATVRNPFIVEYKDSWVEKGCYVCIVIGYCEGGDMADAIKRAN

SEQ ID NO: 50003 - DNA, 672 bp, Panicum virgatum
  misc_feature: Ceres CLONE 2054486
  misc_feature: Encodes the peptide sequence at SEQ ID NO. 50004
acctccctcgccggtccctgattccacgctggctcctcttgactgactccgccgcgggctcccttcaccctcccctcgcgacgccatggctcctccgagtgcctaggacaaggaaggggagatggagatcgaggaagccgccggcgagatggaggaaatggaggcccccgccgtcagcacggtggcggtggcgatcagcgggagcaggagcagcaggcacgcgctcaagtgggccctcgacaagttcgtccccgaagggagggtcctcttccggatcctccacgtgcgcccggcgatcaccatggtgcccaccccaatgggcaattttatcccaatctcacaagtacgggaagacgtagcatctgcatacaggaaagaagcagaatggcaagcgagcaatatgcttcttcctttcaagaagatgtgtgctcagaaaaaggtagaagctgaagctgttttacttgaatcagatgatgttgctgctgcaataagtgaagaaataggaaaattcaatatttccaaattagttttaggttcttcatcaaagaatatattccgaaggaaactcaaaggaagtaagactgcaaccaaaatctctgagtccactccgagcttctgtacagcatatgttatttcaaaaggaaaacttacattcgtgcgctcagctacatc

SEQ ID NO: 50004 - protein, 183 aa, Panicum virgatum
  misc_feature: Ceres CLONE 2054486
  misc_feature (17)..(172): Pfam Name: Usp Pfam Description: Universal stress protein family
MEIEEAAGEMEEMEAPAVSTVAVAISGSRSSRHALKWALDKFVPEGRVLFRILHVRPAITMVPTPMGNFIPISQVREDVASAYRKEAEWQASNMLLPFKKMCAQKKVEAEAVLLESDDVAAAISEEIGKFNISKLVLGSSSKNIFRRKLKGSKTATKISESTPSFCTAYVISKGKLTFVRSAT

SEQ ID NO: 50005 - DNA, 645 bp, Panicum virgatum
  misc_feature: Ceres CLONE 2054530
  misc_feature: Encodes the peptide sequence at SEQ ID NO. 50006
aacagagaaaaaaaaatcgaaatcccgttcgaatcaaacctcctcctccggcctcgccgtggcgcgccgagattccctccggttcccgccaccccagcccgaatctccgtgattggtggggctgcggcctgcggggagggaggcgggatggtggggctcgtggccgcggcgggggtggcgctgggcgacccaccggcggactacgcctccatcgcggcggtggggctgttcgtggcgctcatgtgcgtctgcatcatcgtagggcacctcctcgaggagaaccgctgggtgaacgagtccatcaccgcgctcttcatcgggctcgggacgggagcggtcatcctcttcgcgtcgagcgggaagcactcgcgcgtgctggtgttcagcgaggatctcttcttcatatacctgctgcccccgatcatatttaatgcagggttccaagtaaagaagaagcagttcttccgtaatttcattactattacactatttggtgcagttggaaccttgatctctttcactgtaatatctcttggtgctctaggactaatatcaaggcttgatattggtgcactcgagcttggagactatcttgcacttggggcaatattctcggcaacagactctgtatgcacgttgcaggtg

SEQ ID NO: 50006 - protein, 165 aa, Panicum virgatum
  misc_feature: Ceres CLONE 2054530
  misc_feature: The sequence is a functional homolog of SEQ ID NO 2 in US patent 7250560
  misc_feature: Functional homolog of the protein sequence given in SEQ ID NO 51120
  misc_feature: Useful for making plants with modulated water use efficiency
  misc_feature: The sequence is a functional homolog of SEQ ID NO 2 in US patent 7041875
  misc_feature: Functional homolog of the protein sequence given in SEQ ID NO 51121
  misc_feature: Useful for making plants with modulated drought sensitivity
  misc_feature: The sequence is a functional homolog of SEQ ID NO 4 in US patent 7250560
  misc_feature: The sequence is a functional homolog of SEQ ID NO 4 in US patent 7256326
MVGLVAAAGVALGDPPADYASIAAVGLFVALMCVCIIVGHLLEENRWVNESITALFIGLGTGAVILFASSGKHSRVLVFSEDLFFIYLLPPIIFNAGFQVKKKQFFRNFITITLFGAVGTLISFTVISLGALGLISRLDIGALELGDYLALGAIFSATDSVCTLQ

SEQ ID NO: 50007 - DNA, 505 bp, Panicum virgatum
  misc_feature: Ceres CLONE 2054539
  misc_feature: Encodes the peptide sequence at SEQ ID NO. 50008
tagcttcctccaccaaaccttgcctatagaggacacgaccagcaccgatctatctatcgattaattactagcgaccattccatccgcctccgtcatggcgagctccgatcagggttcgtccggcgcccccaagcccgtgccgggcagctaccggctgccggtgataggcgccctgcaggaccccctggacttctactacttccagagccagaacaagtacttcgagtcccacatccagcgctacagctccaccgcccttcgcttgaacgtgccgccgggcccgttcatggactacgacccgcgcgtggtcgccgtcctcgacgccaagagcttccccctgctcatcgacatggacaaggtccagaagaagaacctcttcacgggcacctacatgccctccaccgacctcaccggcggctaccgcgtgtgctcatacctccacccgtcctagcccatccacaccaaggtgaagcagatgctcttcatcctcctgctctcccgtaag

SEQ ID NO: 50008 - protein, 118 aa, Panicum virgatum
  misc_feature: Ceres CLONE 2054539
  misc_feature: SWISSPROT Homolog: EC 4.2.1.92 Hydroperoxide dehydratase
  misc_feature: Functional homolog of the protein sequence given in SEQ ID NO 50769
  misc_feature: Useful for biocontainment applications
  misc_feature: Useful for making plants with modulated nitrogen use efficiency
MASSDQGSSGAPKPVPGSYRLPVIGALQDPLDFYYFQSQNKYFESHIQRYSSTALRLNVPPGPFMDYDPRVVAVLDAKSFPLLIDMDKVQKKNLFTGTYMPSTDLTGGYRVCSYLHPS

SEQ ID NO: 50009 - DNA, 655 bp, Panicum virgatum
  misc_feature: Ceres CLONE 2054544
  misc_feature: Encodes the peptide sequence at SEQ ID NO. 50010
cccgcccccaatcccgttcccctccccttcgctcgcggccgccgccaggcacgcccgcctccttccgcctcaaagcggctcgtcgcttctggtgctcgtgctgccctccgtcccccctctcctggtggggggaggcgtggatccgaacttgaggggctgatttcttctcttgctcttgccggaagtatggcagatgggggtatcgtggttgccatttgccaatacggtggagagtttacttctgaccccaatggtaatttgatatataaaggaggagaagcgcatgctgttgatgtcactcgtgatatgtcacttgagagcttcaaggatgaggtatccaaggtgttccatgttgatgtcactgacatgtcattcaagtacttccttccgaataataacagaactctcatcacaatatcatgtgatcgagatttacaacggatggttgattttactactagtgctgcacaagtggatgttttcttgattagtagagtggacaacaggagtattgtaactcactctggagcgtctgcaattaaacctgggtctaatacgcctggcgccaaaaggaaaaggacaccttccaaaaacaaagacaaggcatcaaaaaatagcaagacttcaactcccaatgttccaggaactgcatttc

SEQ ID NO: 50010 - protein, 156 aa, Panicum virgatum
  misc_feature: Ceres CLONE 2054544
  misc_feature (20)..(103): Pfam Name: PB1 Pfam Description: PB1 domain
MADGGIVVAICQYGGEFTSDPNGNLIYKGGEAHAVDVTRDMSLESFKDEVSKVFHVDVTDMSFKYFLPNNNRTLITISCDRDLQRMVDFTTSAAQVDVFLISRVDNRSIVTHSGASAIKPGSNTPGAKRKRTPSKNKDKASKNSKTSTPNVPGTAF

SEQ ID NO: 50011 - DNA, 656 bp, Panicum virgatum
  misc_feature: Ceres CLONE 2054550
  misc_feature: Encodes the peptide sequence at SEQ ID NO. 50012
acccttctctgttctctctcacacaatcttccgaccgccctcacctcccccctccccgcacttcccggcgagaggccgggcaccccccctccggcgccgcgcggccgccctctggaccctgtctccccggcgcccgccggcatggcctcgcccaccgtcgcctcgccgggccgggcgagccccgcggtcacccccaccaccgcgccctcgccggcgtccccgccgcggcgcctcttgtcggcgccgcccgccgtcgacgcgtccgggggatcctccccggcctccgccaactccggggaccagctctccgcccccgacgcctcgagcccgatgctcgcgagcaggagcgaggagtacaggcttctgttccggctgccgcccgacgaggttctcgtgcaagattttaactgtgctctccaagaaaatattctgcttcaggggcatatgtatttatttcttcaccatatatgcttctactcaaacatatttggatatgagacgaagaaaacaatacctttgcaggaggtaactgatgttcgtaaagcaaagacagctgccatttttcctaatgccattgaaattgttgctggtagtaaaaggcacttttttggatctttcttgtcacgtgatgaagcttatcgaattatagtggatgg

SEQ ID NO: 50012 - protein, 171 aa, Panicum virgatum
  misc_feature: Ceres CLONE 2054550
  misc_feature (70)..(136): Pfam Name: GRAM Pfam Description: GRAM domain
  misc_feature: SWISSPROT Homolog: EC 2.4.1.173 Sterol 3-beta-glucosyltransferase
MASPTVASPGRASPAVTPTTAPSPASPPRRLLSAPPAVDASGGSSPASANSGDQLSAPDASSPMLASRSEEYRLLFRLPPDEVLVQDFNCALQENILLQGHMYLFLHHICFYSNIFGYETKKTIPLQEVTDVRKAKTAAIFPNAIEIVAGSKRHFFGSFLSRDEAYRIIVD

SEQ ID NO: 50013 - DNA, 682 bp, Panicum virgatum
  misc_feature: Ceres CLONE 2054575
  misc_feature: Encodes the peptide sequence at SEQ ID NO. 50014
gatcactggtgccgatctcccgcgaaacctccccctccccgtgctctgctagacagagatccgggctctcctaggacacgtgtctgtaacagttcatttgaggaaattggcgcccttgtgcggccattatggcattagcttctgccagtgccatgtttcctccctcaaacctttcatataaagcttgggaggacccatcattctttaagtggagaaagcgggaggcgcatgtgccattgcgcccacaggatacgctggaaggagccctgaagtattggcatgagcgaaggaatgtgaactatctcaatgctgacactgctgtctggaatgatgatgcgtttcgcagtgctttagaaagtgctgctgtttggtccaagggcttaccctatactaaatctctaagtggatactggaaatttcttctggctccttcagcagaaagtgttccagagaaattctatgatgctcattttgatgattcaaattgggaggctttgccagtaccctcaaattggcaaatgcatgggtttgaccgtccaatctacagcaatatcacatatcctttcccaataaatccaccatttgtgcccactgataatcccactggctgttacaggacagcttttcacatcccaaaagagtggaaaggtcggaggatcttgctacacttttgagctgtcga

SEQ ID NO: 50014 - protein, 181 aa, Panicum virgatum
  misc_feature: Ceres CLONE 2054575
  misc_feature (85)..(181): Pfam Name: Glyco_hydro_2_N Pfam Description: Glycosyl hydrolases family 2, sugar binding domain
  misc_feature: SWISSPROT Homolog: EC 3.2.1.23 Beta-galactosidase
MALASASAMFPPSNLSYKAWEDPSFFKWRKREAHVPLRPQDTLEGALKYWHERRNVNYLNADTAVWNDDAFRSALESAAVWSKGLPYTKSLSGYWKFLLAPSAESVPEKFYDAHFDDSNWEALPVPSNWQMHGFDRPIYSNITYPFPINPPFVPTDNPTGCYRTAFHIPKEWKGRRILLHF

SEQ ID NO: 50015 - DNA, 615 bp, Panicum virgatum
  misc_feature: Ceres CLONE 2054578
  misc_feature: Encodes the peptide sequence at SEQ ID NO. 50016
cagttcccaaagtggtttcctattgagagggaaacctatcttgaccggttgactttgaggtttgacaaggaagggctgccttctctactcgccccagttgatttctttgtcagtacagttgatcccatgaaggaacctccgttggtcacagcaaatactgttctatctatcctggcggtggattatccagttgacaaggtttcatgctatgtttctgatgatggtgctgccatgctgacatttgaagctttgtctgaaacatctgaatttgcaaagaaatgggttcctttctgcaaaaagtacagtattgagcctcgtgctccagaatggtacttccaactgaagatagactacctgagagataaggtggctccaaacttcgttagggagcggagagcaatgaagagagagtatgaggaattcaaggttagaatcaatgccttggttgctaaagcccaaaaggttcctgaggaaggatggacaatgcaggatgggactccatggcctggaaacaatgttcgtgatcatcctggaatgattcaggtattccttggtcaaagtggtggccatgatgtggaaggaaatgagctgcctcgattggtttacgtttcaaga

SEQ ID NO: 50016 - protein, 204 aa, Panicum virgatum
  misc_feature: Ceres CLONE 2054578
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: The sequence is a functional homolog of SEQ ID NO 6 in US patent 7285702
  misc_feature: Functional homolog of the protein sequence given in SEQ ID NO 50124
  misc_feature: Useful for making plants with altered carbohydrate content
  misc_feature: Functional homolog of the protein sequence given in SEQ ID NO 50260
  misc_feature: Useful for making plants with modulated biomass
  misc_feature: Functional homolog of the protein sequence given in SEQ ID NO 50499
  misc_feature: Useful for making plants with altered cell wall content and/or composition
  misc_feature: The sequence is a functional homolog of SEQ ID NO 2 in US patent 7049481
QFPKWFPIERETYLDRLTLRFDKEGLPSLLAPVDFFVSTVDPMKEPPLVTANTVLSILAVDYPVDKVSCYVSDDGAAMLTFEALSETSEFAKKWVPFCKKYSIEPRAPEWYFQLKIDYLRDKVAPNFVRERRAMKREYEEFKVRINALVAKAQKVPEEGWTMQDGTPWPGNNVRDHPGMIQVFLGQSGGHDVEGNELPRLVYVS

SEQ ID NO: 50017 - DNA, 716 bp, Panicum virgatum
  misc_feature: Ceres CLONE 2054607
  misc_feature: Encodes the peptide sequence at SEQ ID NO. 50018
gaggggtggtggtgaccaggaatcgagagctagcttagctatctatcatggccgcggcggcgcctccgttcccggccgcggtggcggcgctgctgctgctgctctgcctgagcggcggcggctgcaatgcgcagacgccggtgttcgcgtgcgacgcgtcgaacgcgacgctggcggcgtacgggttctgcaaccggtcggcgacggcggcggcgcgcgcggcggacctggtgtcgcggctgacgctggcggagaaggtggggttcctggtggacaagcaggcggcgctgccccggctgggcatcccggcgtacgagtggtggtcggaggcgctgcacggcgtgtcctacgtggggcccggcacgcggttctcgccgctggtgcccggcgccaccagcttcccgcagcccatcctcacggcggcgtccttcaacgccacgctcttccgcgccatcggcgaggtggtgtcgaatgaggcgcgggcgatgcacaacgtggggctggcggggctcacgttctggagccccaacatcaacatcttccgggacccgcggtggggccgcgggcaggagacccccggcgaggacccgctgctcaccagcaagtacgccgtcggctacgtcaccggcctgcaggacgccggctccggcgccggcgacagcctcaaggtcgccgcctgctgcaagcactacaccgcctacgacgtcgaccactgg

SEQ ID NO: 50018 - protein, 222 aa, Panicum virgatum
  misc_feature: Ceres CLONE 2054607
  misc_feature (78)..(222): Pfam Name: Glyco_hydro_3 Pfam Description: Glycosyl hydrolase family 3 N terminal domain
  misc_feature: SWISSPROT Homolog: EC 3.2.1.21 Beta-glucosidase
MAAAAPPFPAAVAALLLLLCLSGGGCNAQTPVFACDASNATLAAYGFCNRSATAAARAADLVSRLTLAEKVGFLVDKQAALPRLGIPAYEWWSEALHGVSYVGPGTRFSPLVPGATSFPQPILTAASFNATLFRAIGEVVSNEARAMHNVGLAGLTFWSPNINIFRDPRWGRGQETPGEDPLLTSKYAVGYVTGLQDAGSGAGDSLKVAACCKHYTAYDVDH

SEQ ID NO: 50019 - DNA, 662 bp, Panicum virgatum
  misc_feature: Ceres CLONE 2054640
  misc_feature: Encodes the peptide sequence at SEQ ID NO. 50020
gcgccctcccctcaatcgctcatctccgaaaaccctactctgtcggcggcgatggcgaagtcggcggcggcggcggaggcagcacctgagactgtggggcaggcggtgatcccgctagtcaacagcctgcaggacatcatcgcacgactggacggcgacgccgccgccagcctggagctgccgcaggtggcggcgatcggcgggcagagcagcggcaagtccagcgtgctggaggcgctcgtcggccgcgacttcctcccgcggggccccgacatctgcacgcgccgtcctctcgtgctccagctcgtgcgccactcggcccccgaggaatggggggagttcctccacgcccccggccgccggttccacgatttcgaacagatcaagcgcgagatccagcttgaaacggacaaagaagctggagacaacaaaggggtttctgagaaacaaattcgtttgaaaatcttttcaccaaatgtcctagacatcaccttggttgatctccctggaataacacgggtgccagttggagaccagcctagtgatattgagtcaagaataaggacaatgatcatgcaatacattaagcatccaagttgtattatcttggctgtctctccagcaaatgcagatttagctaattctgatgcactccaactggc

SEQ ID NO: 50020 - protein, 203 aa, Panicum virgatum
  misc_feature: Ceres CLONE 2054640
  misc_feature (46)..(203): Pfam Name: Dynamin_N Pfam Description: Dynamin family
  misc_feature: SWISSPROT Homolog: EC 3.6.5.5 Dynamin GTPase
MAKSAAAAEAAPETVGQAVIPLVNSLQDIIARLDGDAAASLELPQVAAIGGQSSGKSSVLEALVGRDFLPRGPDICTRRPLVLQLVRHSAPEEWGEFLHAPGRRFHDFEQIKREIQLETDKEAGDNKGVSEKQIRLKIFSPNVLDITLVDLPGITRVPVGDQPSDIESRIRTMIMQYIKHPSCIILAVSPANADLANSDALQL

SEQ ID NO: 50021 - DNA, 711 bp, Panicum virgatum
  misc_feature: Ceres CLONE 2054661
  misc_feature: Encodes the peptide sequence at SEQ ID NO. 50022
aaccgcaacagcaaaaaggcgcctccagagtccagtccccagagagagagagagagagagaggattgattcggagaggtcgacagagaggaggcaaggcgggggcggacggggagcggcgggatcgcccgggaggccgcagccggcggcgcgggcgcggctccgcggtcccctctgggggctgccgctgatccgaccgatccggcgggaatggcggcccggggagggatctagggtcgcgcgggcaatggcggcggcgggggcgcggcgggcggtgtgggcgctcctgctgctgcggctgctgctccacccggccgcgcgcgtgctcgccaacacggaaggtgatgctctgcatagcttaaggactaacttaaatgatcctaataatgttctacaaagttgggatccgactctggtcaacccgtgcacttggttccatgttacctgcaataatgacaacagtgttatcagagttgatcttggaaatgctgcgctatcaggaactttggtcccgcaacttggccagcttaaaaatttgcagtacctggagctctacagtaataacatcagtggcactatacctagtgaacttgggaatctcacaaacttggtcagtttggatttatacttgaacaacttcactggtccaatacctgtttcattggggaacctactgaagctgcggttcttgcgtcttaataacaacagcctt

SEQ ID NO: 50022 - protein, 154 aa, Panicum virgatum
  misc_feature: Ceres CLONE 2054661
  misc_feature (28)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAAGARRAVWALLLLRLLLHPAARVLANTEGDALHSLRTNLNDPNNVLQSWDPTLVNPCTWFHVTCNNDNSVIRVDLGNAALSGTLVPQLGQLKNLQYLELYSNNISGTIPSELGNLTNLVSLDLYLNNFTGPIPVSLGNLLKLRFLRLNNNS

SEQ ID NO: 50023 - DNA, 632 bp, Panicum virgatum
  misc_feature: Ceres CLONE 2054672
  misc_feature: Encodes the peptide sequence at SEQ ID NO. 50024
aaaaaaaaactccctaaaatccctcgccccctcacgctccccacaaaccctcctcgcctcctccctcgcgccgccgccgcctcttctctcctcgcgttcgggaagggcctcgccatggcctcggagacggagacgttcgccttccaggcggagatcaaccagctgctctccctcatcatcaacactttctactccaacaaggagatcttcctcagggagctcatctccaactcctccgatgccttggacaagatcagattcgagagcttgacggacaagagcaagttggatgcccagccagagctgttcatccacattgttcctgacaaggcctccaacactctgacaatcattgacagtggtattggtatgaccaagtcagatctcgtgaacaaccttggtaccattgcacggtcaggcacaaaggagttcatggaggctttggctgctggtgctgatgtttctatgattggccagtttggtgttggtttctactctgcctaccttgttgctgagagagtcgtcgtgaccactaagcacaatgatgatgagcagtatgtgtgggagtctcaggctggtggctccttcactgtcacacgtgatacctctggggagccccttggcaggggtac

SEQ ID NO: 50024 - protein, 172 aa, Panicum virgatum
  misc_feature: Ceres CLONE 2054672
  misc_feature (28)..(165): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHIVPDKASNTLTIIDSGIGMTKSDLVNNLGTIARSGTKEFMEALAAGADVSMIGQFGVGFYSAYLVAERVVVTTKHNDDEQYVWESQAGGSFTVTRDTSGEPLGRG

SEQ ID NO: 50025 - DNA, 647 bp, Panicum virgatum
  misc_feature: Ceres CLONE 2054712
  misc_feature: Encodes the peptide sequence at SEQ ID NO. 50026
accggatcgaacaatctctccgcctgccgcatcgccgccgccgccgcccatggccgccgtcgctcccgtcgtctccgaccttgtcgacttcctcaacgtgtcgcccactgccttccacgccgtcgacgaggcgaagcggcggctgaaggcggcggggttcgcgcagctctcggagcgggaggagtggtcggggctcgagcccggccgcaagtatttcttcacacgcaaccactccaccatcgttgccttcgccatcggcggcaaatacgttgctggcaatgggttccacgtcatcggtgcgcacactgacagcccttgcctcaagctcaagcccgtctccaaggtaccaagcctggagtcttgcttactgattggagagtaccttacatcctgtgttgcaattttgatatgatagcacgtgtctgttaattgttaaaccagtgatacatgtattattcaggaacaattttttttactgcgtattaggtagtacctgatgatacacattgtgatcaataagtgccagactgccagtatcttgcttcttgtttcgcaggtaaccaaaggaggttatcttgaggttggggtacaaacatatggtggtggattgtggtacacatggttcgaccgtgatcttactatagctg

SEQ ID NO: 50026 - protein, 120 aa, Panicum virgatum
  misc_feature: Ceres CLONE 2054712
  misc_feature: SWISSPROT Homolog: EC 3.4.11.21 Aspartyl aminopeptidase
MAAVAPVVSDLVDFLNVSPTAFHAVDEAKRRLKAAGFAQLSEREEWSGLEPGRKYFFTRNHSTIVAFAIGGKYVAGNGFHVIGAHTDSPCLKLKPVSKVPSLESCLLIGEYLTSCVAILI

SEQ ID NO: 50027 - DNA, 637 bp, Panicum virgatum
  misc_feature: Ceres CLONE 2054718
  misc_feature: Encodes the peptide sequence at SEQ ID NO. 50028
actcgcatcacaggccccaatcccatgccgccgccccaccgaacctgcttctttgatagccttcctctgctttcccctccgatctttgctcggtccctggctaaacatgaccgaatcctttgtgctcaacaccggcgcgaggatcccatcggttggccttggcgtatggcaaattcagcctgacgccgtcggcaacgccatctatgctgctgtcaaggctgggtatcggcacattgattgcgctgcagcatacagcaatgagaaggaggtaaatagtaattactttcacccagtttaccatcacataaattttctgttccatgtgcacactgctatttctttatcgtaactgattaggttgtaattgttggttctctcaagaaatatatttattgacttactttagtttatcacacaatcatatgattgtttcaactcacctgaatatgacacgatgcatgtcataactttattctttactcctattttctacatcatgtagaacatttcttgtaaggaaattcgattagttcatttttaaaagcagtatttagagaagaatcatatccagatatagtgataataagtcaatcagataaaagtgataagataataagaaggaatgtaaggatagcac

SEQ ID NO: 50028 - protein, 80 aa, Panicum virgatum; identical to SEQ ID NO: 48964
  misc_feature: Ceres CLONE 2054718
  misc_feature: SWISSPROT Homolog: EC 1.1.1.21 Aldehyde reductase

SEQ ID NO: 50029 - DNA, 689 bp, Panicum virgatum
  misc_feature: Ceres CLONE 2054724
  misc_feature: Encodes the peptide sequence at SEQ ID NO. 50030
acacacacgaacactttcgacgcggggacgcggacgcccggcccgagcgcacgcgcgaatcgccgtggacctcgccgggggcggcgacgagctcggatcccggcgatctagtcgccggaggcggcccccatggctcgccggtcgtcgtcctcgtcgtcgggggcgtggcggtacctcaaccccgcgtactacctcaagcggcccaagcgcctcgcgctcctcttcttcgtcttcgtcgcggccaccttcgccttctgggaccgccagtcgctcgtgcgcgagtacgagtctgagatttccagattagaagatgatattaatcggttgcatgaccagctaagaaaggctggagtccatgtggatgaaaatccaagtaacgccagaaaagatcttgtagaaatcgatcctgtgaataatgaaaggagggaaaaagttaaggaggcaatgctccatgcttggaattcctatgtaaagtatgcctggggaatggatgagcttcagccacaatcaaagaatggcatcaatagctttggtggccttggagcaacccttgtggactcacttgatacactgtatatcatgggcctgaaagatgaatttcagaaagctagagactgggtggccgagtcattagactttgacaaggattatgatgcaagtgtttttgaaacgaccattagggtcgttgg

SEQ ID NO: 50030 - protein, 186 aa, Panicum virgatum
  misc_feature: Ceres CLONE 2054724
  misc_feature: SWISSPROT Homolog: EC 3.2.1.113 Mannosyl-oligosaccharide 1,2-alpha-mannosidase
MARRSSSSSSGAWRYLNPAYYLKRPKRLALLFFVFVAATFAFWDRQSLVREYESEISRLEDDINRLHDQLRKAGVHVDENPSNARKDLVEIDPVNNERREKVKEAMLHAWNSYVKYAWGMDELQPQSKNGINSFGGLGATLVDSLDTLYIMGLKDEFQKARDWVAESLDFDKDYDASVFETTIRVV

SEQ ID NO: 50031 - DNA, 731 bp, Panicum virgatum
  misc_feature: Ceres CLONE 2054748
  misc_feature: Encodes the peptide sequence at SEQ ID NO. 50032
gccagtacccggaggagtagccgccgccgcgaacacaggagcagcgggaacatacaggaccggcaagatgcagatcttcgtgaagacgcttactgggaagaccatcaccctcgaggtcgagagcagcgacaccatcgacaatgtcaaggccaagatccaggacaaggaaggaatcccgccggaccagcagcgtctgatcttcgccgggaagcagctggaggatggccgcactctggcggactacaatatccagaaggagtccacgctccacctcgtgctcaggctccgtggtggaattattgagccctcgctgcaggcgctcgcgcgcaagtacaatcaggacaagatgatctgccgcaagtaagccaccactcacgccctcagcttgtctacatttctgtgacccccaaatggaggctttgttctcttcagtgcaatattatctttcgattagatgccacctccaactggatcgacgattgttattcgttggaggtttacacgatatgctttcaatgatatatggatatgatagtcacacggggttatgcttgtattgcggttcatgtatggaaaagtttttttcaagtctaattctagtgagaaatgaacaattcagcaaacacgtgcactttcagcattcgggaaggaacttggtgtgtaaaagtgtgattgccctagctgaagtgccattttcttttttgtaacactgtgctttccctttgtagctt

SEQ ID NO: 50032 - protein, 98 aa, Panicum virgatum
  misc_feature: Ceres CLONE 2054748
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRK

SEQ ID NO: 50033 - DNA, 583 bp, Panicum virgatum
  misc_feature: Ceres CLONE 2054750
  misc_feature: Encodes the peptide sequence at SEQ ID NO. 50034
ccctttctcgcggcctcactcccttgtttccactctccccgacggaggccgcagccgccacgcccccaatgccgacgcgcctccaccacctcctgctccccctcctccttgccgccgccgcttccgtggctgccagcggcaacgcggatgcggacgcgctgctggcggcgaaggcggcgctcgcggacccggccggcgcactggcgtcctggacggcgagcgccgccgccgccgccgccccgtgcgcgtgggccggtgtgacgtgcaacgcgcgcgcggcggtcatcgggctcgacctctccggccgcaacctctcgggccccgtcccggcggcgctctcccggctggcgcacctcgcgcggctcgacctcgccgccaacgcgctctcgggccccatcccggcggcgctggcccggctcgggtccctcacccacctcaacctctccaacaacgtgctcaacggcaccttcccgccgccgctggcgcgcctgcgcgcgctccgggtgctcgacctctacaacaacaacctcaccggcccgctcccgctcgaggtcgcggcgctgccgctgctgcgccacctcca

SEQ ID NO: 50034 - protein, 171 aa, Panicum virgatum
  misc_feature: Ceres CLONE 2054750
  misc_feature (24)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MPTRLHHLLLPLLLAAAASVAASGNADADALLAAKAALADPAGALASWTASAAAAAAPCAWAGVTCNARAAVIGLDLSGRNLSGPVPAALSRLAHLARLDLAANALSGPIPAALARLGSLTHLNLSNNVLNGTFPPPLARLRALRVLDLYNNNLTGPLPLEVAALPLLRHL

SEQ ID NO: 50035 - DNA, 635 bp, Panicum virgatum
  misc_feature: Ceres CLONE 2054756
  misc_feature: Encodes the peptide sequence at SEQ ID NO. 50036
attcacacgcacacagagcactggagcacacactcttcttgtgccgaagaattatttattgccaccgcatcgattcttagtactgggacttgattactcattcctcgctgctccatccaccccatgttcttgaatttctcgggatattttctcccaccccagtctgcgccggagctgcatttgctccggatttatagcctcccgctttagcccgtccttcctgtttctcctttttttccccagtggggaggttggcatcaggcacaagcaaagcgcgggttcttcttgcagtttctgcactcccctttttgctgctaaatctgcctgcaagatctgatacaaaggccgggagggagagagagccaccaaggggggaggttcttggtgctgttcttgtgtggaattcttgagcaatgaggcccgacgcgcggctcgatgcggtggtcttccagctcacgcccacccggaccaggtttgatttggttctgatagcgaatggccgtaaggagaagctagcatctggtttgctgaaaccattcctggcacacctgaaggctgctcaggatcagatttcgaagggaggatactcgatcacactcgaaccaagctcgggattcgatgcaccatggtttacg

SEQ ID NO: 50036 - protein, 73 aa, Panicum virgatum
  misc_feature: Ceres CLONE 2054756
  misc_feature: Functional homolog of the protein sequence given in SEQ ID NO 51410
  misc_feature: Useful for making plants with altered cell wall content and/or composition
MRPDARLDAVVFQLTPTRTRFDLVLIANGRKEKLASGLLKPFLAHLKAAQDQISKGGYSITLEPSSGFDAPWF

SEQ ID NO: 50037 - DNA, 645 bp, Panicum virgatum
  misc_feature: Ceres CLONE 2054764
  misc_feature: Encodes the peptide sequence at SEQ ID NO. 50038
aggttttcggaaacaagaagaatggtgaacgatctttttgagcagagaaaagctcttcaggcaggatccaggggcttgaagaaccttggaaattcgtgcttcatgaactctgcaattcaactggtagcccatgtacctccgtttgtctcttcggtgttttctccgagttttgattccgcccttcccctctcaagctcattctctaaacttcttaagatgatatgggaagataaagagagtcaagaggtgctctcgtacatagatccctctttttttcgtacaattgttggaagtctctcagaacagttcaccaaccaacaacagcaagatccacaagagtttctttcacttttccttgatggactacacgaggagttgaggatagcatcaaaaggaaaacaagaagactattctaagcacgaagaaccacaggttaatagagatggaccattcagttctcttgacgaagagatccaacagaaatcaattattgcttgggagacttatattcgtgataacaagtccattattaccgatctatttcatggacaactcctctcttctcttgcttgtgcccattgcaagaaaatcctctcattcacttttgacccatttgtttttctctctcttcctattccgacgagg

SEQ ID NO: 50038 - protein, 214 aa, Panicum virgatum
  misc_feature: Ceres CLONE 2054764
  misc_feature (21)..(200): Pfam Name: UCH Pfam Description: Ubiquitin carboxyl-terminal hydrolase
  misc_feature: SWISSPROT Homolog: EC 3.1.2.15 Ubiquitin thiolesterase
RFSETRRMVNDLFEQRKALQAGSRGLKNLGNSCFMNSAIQLVAHVPPFVSSVFSPSFDSALPLSSSFSKLLKMIWEDKESQEVLSYIDPSFFRTIVGSLSEQFTNQQQQDPQEFLSLFLDGLHEELRIASKGKQEDYSKHEEPQVNRDGPFSSLDEEIQQKSIIAWETYIRDNKSIITDLFHGQLLSSLACAHCKKILSFTFDPFVFLSLPIPT

SEQ ID NO: 50039 - DNA, 653 bp, Panicum virgatum
  misc_feature: Ceres CLONE 2054766
  misc_feature: Encodes the peptide sequence at SEQ ID NO. 50040
aaccccttcctccgctttcccttcgcgcgcacgcctcctccgcgatttcgtcgagcaccccccgcgccgcgccgcgccgcgccgcgccatgccgccgcccgccggcgcgtcccgctccggcgccggctccgaagaacccgagtccccggcggcgcgccgcctccgccgcctctccctgcacctcctccacctcgagccctcccccgccccggccgatcaggcggcgggcccggcgctggcccccgcggcgtgcgcggggcgggcgcggcgcgtccagggcggcgcggacgtggcggcggcgctggcggcgtacctgcggggccggcaccgcgcggcgcagctgcggctgttcgacttcctccgcgcgcgcccggacctgcagacgcccgtggagctcgccacggccgcgcaccgggagctctgcttccgccagctgcgcgcgctggtgcgggacgccggggtgcgcccgctcacgctcatggccaccgaccccgccgagtacttcgccgtcatggaggccgccggcggcgccgacatctccctcggcgtcaagctgggcgtccagtacagcctctggggaggttctgtcataaatttaggaaccaaaaagcacagagataagttctttgatggaattgacaatttggattacc

SEQ ID NO: 50040 - protein, 188 aa, Panicum virgatum
  misc_feature: Ceres CLONE 2054766
  misc_feature: SWISSPROT Homolog: EC 1.3.3.6 Acyl-CoA oxidase
MPPPAGASRSGAGSEEPESPAARRLRRLSLHLLHLEPSPAPADQAAGPALAPAACAGRARRVQGGADVAAALAAYLRGRHRAAQLRLFDFLRARPDLQTPVELATAAHRELCFRQLRALVRDAGVRPLTLMATDPAEYFAVMEAAGGADISLGVKLGVQYSLWGGSVINLGTKKHRDKFFDGIDNLDY

SEQ ID NO: 50041 - DNA, 700 bp, Panicum virgatum
  misc_feature: Ceres CLONE 2054803
  misc_feature: Encodes the peptide sequence at SEQ ID NO. 50042
aaaaaaatcgacgggaatacgggacggagccattccactcgcgcgcttcacgcgcgggtttcctctccctactcatcccaactcgctcatctttcttcccctcctctccctgccgggcggcggcgcatctgtccgatcgccggtgaggcagcggcggcggacggcctccctctaccccgtgtaggaaagcaggcgccctcatatccatcctgcacgcatcggaggggaggcctgccccctcctatctcgtccaggggagccccgggtcctcctgcacgcatcggaggggagcccagggacgccgccgcgcgccctcgtctctcgtcggctgcttctcgtccccgtttccttctcctcggctgccggatctcgagtttgtttgcccaagaccatggagagtacttcagatatacagatgcaacattgccctgaagattctgagactacaattgagatcaaaatcaagaccttggattctcagacatacaatttgcgtgtgaataaatgtgtgccggttcctctgttgaaggaaaaaattgctactgtaacaggaatattgtctgaacagcaacgcttgatttgccgtgggagagtcttaaaggatgatgaactcttgtctgcttatcatgttgaagatggtcatacattgcatcttggttgtcagacaaccaggacagtcagctctgtcaagaaaatgcag

SEQ ID NO: 50042 - protein, 102 aa, Panicum virgatum
  misc_feature: Ceres CLONE 2054803
  misc_feature (25)..(93): Pfam Name: ubiquitin Pfam Description: Ubiquitin family
MESTSDIQMQHCPEDSETTIEIKIKTLDSQTYNLRVNKCVPVPLLKEKIATVTGILSEQQRLICRGRVLKDDELLSAYHVEDGHTLHLGCQTTRTVSSVKKM

SEQ ID NO: 50043 - DNA, 613 bp, Panicum virgatum
  misc_feature: Ceres CLONE 2054826
  misc_feature: Encodes the peptide sequence at SEQ ID NO. 50044
gtccggtcgtcccgtctcggcctcgcctcgcatcgcctctctctctagctgcttgtgcttctctctctagcccccctcctccctcatctcctcccccactcgcacagtgcccaatgccgcgcaaaccctagtgcccccactcccgatctcgcgcggcagccatggggaactgctgccgctcgccggccgccgccgcgcgggaggacgtcaagtcgtcgcactttccggcctccgccggcgggaagaaaaagccccaccaggcgcggaacggcgctggggccggcgcgggcggcggcggcgccggggagaagaagcggctgtcggtgctcggggaggaggggtgcgacgtgggcgccgggatcgaggagaagtacgccctggaccgggagctggggcgcggcgagttcggggtgacgtacctgtgcatggaccggggcacgcgggagctgctggcctgcaagtcgatctcgaagcggaagctgcggacgcccgtggacgtggaggacgtgcgccgggaggtggccatcatgcggcacctgcccaagagccccagcatcgtgtcgctgcgggaggcgtgcgaggacgacggcgccgtgcacctcgtcatggagct

SEQ ID NO: 50044 - protein, 150 aa, Panicum virgatum
  misc_feature: Ceres CLONE 2054826
  misc_feature: SWISSPROT Homolog: EC 2.7.11.1 Non-specific serine/threonine protein kinase
MGNCCRSPAAAAREDVKSSHFPASAGGKKKPHQARNGAGAGAGGGGAGEKKRLSVLGEEGCDVGAGIEEKYALDRELGRGEFGVTYLCMDRGTRELLACKSISKRKLRTPVDVEDVRREVAIMRHLPKSPSIVSLREACEDDGAVHLVME

SEQ ID NO: 50045 - DNA, 631 bp, Panicum virgatum
  misc_feature: Ceres CLONE 2054835
  misc_feature: Encodes the peptide sequence at SEQ ID NO. 50046
accatccaaagatccacgtagagcacaacacctgtcacgaagccatgaacggcgccatggcgagcgccttcggtagctcgacgagccccctcgtcccggcggtggtggctcccgctgcctcggccaagtcctctgcatgcccgtccaagaaaacccccgccgccacctacccccgccgcaccgtgtggtgccgggccgccggcgggcgcgacgacgacggcctcctctggctcccccgccgggacgtgctcaccagcctaggcggcgtcgccgccggcctcgtcgggtacccaggcctcgcgtccggcgcccagccggaggcgatccccctcgagagctgccgccgcggcgacaaggtgaacgagagcctggtgaagtgcacggaccccaaccgggagttcccgtgcccgccgccggcgcacgtcaaggccgtcgacttcacgccggagccgacggtgaagcgcgtccggcagccggcgcacctcctgagccgggagaaccaggagaagtacaaggaggccatcgcccggatgaaggcgctgccggcgagccacccgctgagcttcgcggcgcaggcggcgatccacgagtcctactgcgacgggcactaccggtacgacccggcggagaa

SEQ ID NO: 50046 - protein, 191 aa, Panicum virgatum
  misc_feature: Ceres CLONE 2054835
  misc_feature: SWISSPROT Homolog: EC 1.10.3.1 Catechol oxidase
MASAFGSSTSPLVPAVVAPAASAKSSACPSKKTPAATYPRRTVWCRAAGGRDDDGLLWLPRRDVLTSLGGVAAGLVGYPGLASGAQPEAIPLESCRRGDKVNESLVKCTDPNREFPCPPPAHVKAVDFTPEPTVKRVRQPAHLLSRENQEKYKEAIARMKALPASHPLSFAAQAAIHESYCDGHYRYDPAE

SEQ ID NO: 50047 - DNA, 702 bp, Panicum virgatum
  misc_feature: Ceres CLONE 2054849
  misc_feature: Encodes the peptide sequence at SEQ ID NO. 50048
agccagcgcccacacagcttctactgctgctccgaaacctgccccgggctcgacagccgagctgatcgtgcggggcgccaatggtgaacaccgggcgcttcgtcatcctcgtcctcgcctaccgcttcctggtacccatcctctcagccgaaccggaccacgccgccagagaggtagtgtgatgctgttgatcgattggcagctgagctgcaagatggagctgaattcagtagcagccactgtcttggataggataggattatattatgcttaatgcttgcttgttccatcagactcgctgaattttgcttgctgatctgatggtgctggcggttcatcagtcgtatgtcgtctacatggggagcccgtcgggcggcggcggcgacctggaggcggtgcaggcggaccacctgcagatgctgtcgtccgtcatcccgagcggcgagcaggggagggcggcgctgacgcagagctaccaccacgcgttccagggcttcgccgccgcgctcaccgacaaggaggccgccgcgctctccgggcacgagagggtggtgtcggtgttcaaggaccgcgcgctacagctgcatacgacgcgctcctgggacttcctcgaggtgcagtccgggctccagtccggccgcctcggccgccgcgcgtccggcgacgtcatcatcggcgtcatcgacactggtgtctggccgg

SEQ ID NO: 50048 - protein, 127 aa, Panicum virgatum
  misc_feature: Ceres CLONE 2054849
  misc_feature (7)..(89): Pfam Name: Subtilisin_N Pfam Description: Subtilisin N-terminal Region
  misc_feature: SWISSPROT Homolog: EC 3.4.21.25 Cucumisin
MVLAVHQSYVVYMGSPSGGGGDLEAVQADHLQMLSSVIPSGEQGRAALTQSYHHAFQGFAAALTDKEAAALSGHERVVSVFKDRALQLHTTRSWDFLEVQSGLQSGRLGRRASGDVIIGVIDTGVWP

SEQ ID NO: 50049 - DNA, 426 bp, Panicum virgatum
  misc_feature: Ceres CLONE 2054888
  misc_feature: Encodes the peptide sequence at SEQ ID NO. 50050
cgaatcgatttcatcactcttgaaatccccatcgcctatcggtggatcaaacgttcgaaacccccattccgaactagaaaatccaaatcgctaagctccgaaaccctaaccctagtctctcctcccgccaccgcccgccccaatggcgaagccggtgaagtacgaggaggaggaggaggaggaggagatctcgtcctccgccgaggaggaggaggatgaccagtccgacgcggccggctccggatctggcgaggagggggacgaggacgaggaggacgccgcggcacctcccgcgggggaggaggaggaagctgagggagaggggcagcaggagttggaggaggaggtcgatgaggaggagatcctcgaccccaaaaaacttgattagggtgatggttcacgtagtgggccatcgccctgatagac

SEQ ID NO: 50050 - protein, 81 aa, Panicum virgatum
  misc_feature: Ceres CLONE 2054888
  misc_feature: The sequence is a functional homolog of SEQ ID NO 1582 in the 10/412,699 US patent application
MAKPVKYEEEEEEEEISSSAEEEEDDQSDAAGSGSGEEGDEDEEDAAAPPAGEEEEAEGEGQQELEEEVDEEEILDPKKLD

SEQ ID NO: 50051 - DNA, 682 bp, Panicum virgatum
  misc_feature: Ceres CLONE 2054894
  misc_feature: Encodes the peptide sequence at SEQ ID NO. 50052
cgcctcggcctctacggcttcacggacgccgacctcgacagggagttcttcctcggcgtctggaggatgtccggtttcctctccgagaaccgccccgtcctcaccctccgcgagatcctcagcaagctccagcaggcctactgcggccccatcggctacgagtacatgcacatccccgacagggacaagtgcaactggctcagagaaaagatcgagaccgccaagcccagggactacgacaaggaccgccgcctcgtcatgctcgacaggctcatctggagcacgcagttcgagaacttcctcgccaccaagtgggctaccgccaagaggtttggccttgagggtggtgagacgctcatccctggcatgaaggagatgttcgatagggctgctgacctcggcgtcgagaacattgtcatcgggatgccgcacagggggaggctcaatgtccttggtaatgttgtccgcaaaccgttgtctcagatattcagcgagttcactggtggcacgaggcctgttgaaggtgaggatgggctctacactagaactggtgatgtcaagtaccacctgggtacctcctatgaccgcccaactcgtggtggcaagaggattcacttgtccttggtcgccaatcccagtcatctggaagctgttgatcctgttgtcattggcaagacgcgtg

SEQ ID NO: 50052 - protein, 227 aa, Panicum virgatum
  misc_feature: Ceres CLONE 2054894
  misc_feature: SWISSPROT Homolog: EC 1.2.4.2 Oxoglutarate dehydrogenase (succinyl-transferring)
RLGLYGFTDADLDREFFLGVWRMSGFLSENRPVLTLREILSKLQQAYCGPIGYEYMHIPDRDKCNWLREKIETAKPRDYDKDRRLVMLDRLIWSTQFENFLATKWATAKRFGLEGGETLIPGMKEMFDRAADLGVENIVIGMPHRGRLNVLGNVVRKPLSQIFSEFTGGTRPVEGEDGLYTRTGDVKYHLGTSYDRPTRGGKRIHLSLVANPSHLEAVDPVVIGKTR

SEQ ID NO: 50053 - DNA, 563 bp, Panicum virgatum
  misc_feature: Ceres CLONE 2054898
  misc_feature: Encodes the peptide sequence at SEQ ID NO. 50054
aatttcgaaacacgggaccaacgccatctccaaaaccccaaaccctcgttccccttcgccattatccgaacccagaccaagcaccaagctccgaccacagagccgagccccaaatggccgccgcctcttccatgctgaccgccgcgtcgctctccttcgccgccctcccggtctcgcgcctccgagccgcccttcccaccgccgcctccttcgcggcgctgcggcgcgcggcggccgcacccgtcgtcgtgcgcgcggcggccgcctcgtccaaggccacggctgcggcggaggcggccccgaagaagaaaagggcgaccggcatcacccagcccaagcccgtctcgccggcgctgcaggcaatcgtgggcgcaccggagatcccccgcaccgaggcactcaagcgcctctgggcctacatcaagcagcacaacctccaggtcccggagcaaaacccttacctacttaccctgtacctgtagtgtggtcgctgtagcttgtttggatgccgattagagacgttttataacttcaaacaaacactaatttggcattttactctg

SEQ ID NO: 50054 - protein, 122 aa, Panicum virgatum
  misc_feature: Ceres CLONE 2054898
  misc_feature (71)..(122): Pfam Name: SWIB Pfam Description: SWIB/MDM2 domain
MAAASSMLTAASLSFAALPVSRLRAALPTAASFAALRRAAAAPVVVRAAAASSKATAAAEAAPKKKRATGITQPKPVSPALQAIVGAPEIPRTEALKRLWAYIKQHNLQVPEQNPYLLTLYL

SEQ ID NO: 50055 - DNA, 707 bp, Panicum virgatum
  misc_feature: Ceres CLONE 2054939
  misc_feature: Encodes the peptide sequence at SEQ ID NO. 50056
aatctgctgccgacgccatggcgaggatcagggccccgcgtctcgccgtcctcctcgctctcgccgcgctcgcggccgtcgcggcggcggcggccgcggccggcgaggcgcgcgcgcagtccacgtacatcatccacctcgcgcccgaccacccggcgctgtccgcggcgcgcgccgacggcggcggcgaggcggtcctcggccgcctcctcccgcgccggctgcgcgcgccccggccgcgcgtgctctacacctacgcgcacgcggccacgggcatcgcggcgcgcctcacgcccgagcaggcggcgcacgccgcggccggggagggcgtcctggccgtctacccggaccaggcgcggcagctgcacaccacccacaccccgtcgttcctccacctgaccgaggccgcggggctcctgccggccgcggcggggagcgcgtcgtcgaccgtcgtgggcgtgctcgacaccgggctctaccccatcggccggggctcgtttgcgccagctgctgggctaggcccggcgcccgcgtccttctccggtggatgcgtctccacgagatctttcaacgcctccgcctactgcaacagcaagctcatcggcgccaagttcttctaccaggggtacgaggctgctctcggccaccacatcgatgagaccaaggagtccaaatcgccgttggacactgagggccacgggacgcac

SEQ ID NO: 50056 - protein, 229 aa, Panicum virgatum
  misc_feature: Ceres CLONE 2054939
  misc_feature (35)..(117): Pfam Name: Subtilisin_N Pfam Description: Subtilisin N-terminal Region
  misc_feature: SWISSPROT Homolog: EC 3.4.21.25 Cucumisin
MARIRAPRLAVLLALAALAAVAAAAAAAGEARAQSTYIIHLAPDHPALSAARADGGGEAVLGRLLPRRLRAPRPRVLYTYAHAATGIAARLTPEQAAHAAAGEGVLAVYPDQARQLHTTHTPSFLHLTEAAGLLPAAAGSASSTVVGVLDTGLYPIGRGSFAPAAGLGPAPASFSGGCVSTRSFNASAYCNSKLIGAKFFYQGYEAALGHHIDETKESKSPLDTEGHGT

SEQ ID NO: 50057 - DNA, 606 bp, Panicum virgatum
  misc_feature: Ceres CLONE 2054976
  misc_feature: Encodes the peptide sequence at SEQ ID NO. 50058
aacgcacagagcaggcacgccccccgctctccctctccgtgccacccgcccccaaaccctcgccgccgcctccgagacagccgccgccaccatggccacgaccgccgccgcgctcaccggcgccgccaccaccgccgccgcgccgaggccgaggccgaggcgcagcgcgcacctcccgtccgcccggcgcgccgccgcgcccatccggtgctccgcggtggcgccggcctcggccgcccccgccaccccgctccggccgtgggggcccatcgagccgcgcaagggcgccgacatcctcgtcgaggccctcgagcgctgcggcgtccgcgacgtcttcgcctaccccggcggcgcgtccatggagatccaccaggcgctcacgcgctcccccgtcatcgccaaccacctcttccgccacgagcagggggaggccttcgccgcctccgggttcgcgcgctcgtccggccgcgtcggcgtctgcgtcgccacctcgggccccggcgccaccaacctcgtctccgcgctcgccgacgcgctgctcgactccgtccccatggtcgccatcacgggccaggtgccccgccgcatgatcggcaccgacgcctt

SEQ ID NO: 50058 - protein, 171 aa, Panicum virgatum
  misc_feature: Ceres CLONE 2054976
  misc_feature (63)..(171): Pfam Name: TPP_enzyme_N Pfam Description: Thiamine pyrophosphate enzyme, N-terminal TPP binding domain
  misc_feature: SWISSPROT Homolog: EC 2.2.1.6 Acetolactate synthase
  misc_feature: Functional homolog of the protein sequence given in SEQ ID NO 51562
  misc_feature: Useful for making plants with modulated herbicide sensitivity
MATTAAALTGAATTAAAPRPRPRRSAHLPSARRAAAPIRCSAVAPASAAPATPLRPWGPIEPRKGADILVEALERCGVRDVFAYPGGASMEIHQALTRSPVIANHLFRHEQGEAFAASGFARSSGRVGVCVATSGPGATNLVSALADALLDSVPMVAITGQVPRRMIGTDA

SEQ ID NO: 50059 - DNA, 674 bp, Panicum virgatum
  misc_feature: Ceres CLONE 2054977
  misc_feature: Encodes the peptide sequence at SEQ ID NO. 50060
aactctcacaactccccccaaattccttcaccccgaagcacccaaccccccaaccccacccccgatcccctcccccaccccgcctccggccaccgcgtccgcctcccgatggcgtcggcggcggggtcctccaacgtgatgctcgcgatccacgagaagaagacgacccccaccgacctctaccgcccgctccgcctctacatcgcctccgcctactcggagcgcgaggccgcggcggccgacgacgacctcagcgcggtgcgcgacctccgcgccgaggtcgagcagccctccctcccggacccgtcctccctcgagcagcgccgggacgcgctcctcgcctacgcccgggcgctcgcgctcgtggagccccgcttccccatctcccccgaccgcgcccacgtccactccctcaccttcacctggcgcgacgccttcaaggggaacaagaagtgcgccctcggctccatccacctcgagaaggccaccgtgctcttcaacctcggcgccgtctactcccagatcgcgctcgccgcggaccgctccaccgatgtcgggatccggaccgcgtgcggcgcgttccagagcgcggcgggggcattcgcctggctcagggagagcggggtcgcggccaaggccgtcgccgcgggggctaccaccgtcgacatcacgcc

SEQ ID NO: 50060 - protein, 188 aa, Panicum virgatum
  misc_feature: Ceres CLONE 2054977
  misc_feature (10)..(187): Pfam Name: BRO1 Pfam Description: BRO1-like domain
  misc_feature: SWISSPROT Homolog: EC 3.1.3.48 Protein-tyrosine-phosphatase
MASAAGSSNVMLAIHEKKTTPTDLYRPLRLYIASAYSEREAAAADDDLSAVRDLRAEVEQPSLPDPSSLEQRRDALLAYARALALVEPRFPISPDRAHVHSLTFTWRDAFKGNKKCALGSIHLEKATVLFNLGAVYSQIALAADRSTDVGIRTACGAFQSAAGAFAWLRESGVAAKAVAAGATTVDIT

SEQ ID NO: 50061 - DNA, 525 bp, Panicum virgatum
  misc_feature: Ceres CLONE 2054987
  misc_feature: Encodes the peptide sequence at SEQ ID NO. 50062
atcctcctctgcctctccctctcccggatccgatccgtagtggctggcgtctcggttcctcgccggtggcagcggcgctcggctagcggcggcgactgggagaggtcttcgctggcggcgatcctccactccgtcggttggcggctgcggccgccgcgggagatggaggcggacgccgggaagctgttcatcggcggaatctcgtgggacaccaacgacgaccgcctccgggagtacttcgacaagtatggtgaggtggtggaggccgtcatcatgcgcgaccgggccaccggccgcgctcgaggcttctggttcatcgtgttcgccgaccctgctgtcgccgagcatgtgattatggagaaacacatgatcgactgcccgatggtggaggcgaagaaagctgtccccacatatgatcagcatgctctgagcaatagcggtggcagcactcatggatcaccagggcccattcgcactaagaatatattcgtcggtgctttggcttccaccgtgaccgaagcatac

SEQ ID NO: 50062 - protein, 120 aa, Panicum virgatum
  misc_feature: Ceres CLONE 2054987
  misc_feature (8)..(72): Pfam Name: RRM_1 Pfam Description: RNA recognition motif. (a.k.a. RRM, RBD, or RNP domain)
MEADAGKLFIGGISWDTNDDRLREYFDKYGEVVEAVIMRDRATGRARGFWFIVFADPAVAEHVIMEKHMIDCPMVEAKKAVPTYDQHALSNSGGSTHGSPGPIRTKNIFVGALASTVTEA

SEQ ID NO: 50063 - DNA, 657 bp, Panicum virgatum
  misc_feature: Ceres CLONE 2054997
  misc_feature: Encodes the peptide sequence at SEQ ID NO. 50064
cagctaagtctgctttctgaagaggatctcaaaggaccgatccgagtgtcatttattaatgagcatggtgaggaagaggctggaattgatggtggcggaattttcaaagatttcatggaaaatatcactcgagctgcttttgatgtacagtatggtctcttcaaggagacagctgatcatcttctgtacccaaaccccgcatcaggattggttcatgaactacacctgcaatatttccattttcttggaagtctccttggaaaggcaatgtatgagggcatacttgtggacttgccatttgcaacgttcttcttgagcaagttgaaacaaaagtacaattttttaaatgatcttccttcattggatccagaattatatcgacatcttctgttcttaaagcattacaacggtgatatctcagaactggaactgtattttgtcattgtgaataatgaatatggtgaacagtgtgaagaagaacttctccctggtgggagagacatgcgtgttactaatgataatgttattacttttatccatcttgttgccaatcatcggttaaactaccagattcgtgcacaaagtacacacttcttgcgaggttttcaacagcttataccaaaagactggattgatatgttcaatgaacatgaaatt

SEQ ID NO: 50064 - protein, 218 aa, Panicum virgatum
  misc_feature: Ceres CLONE 2054997
  misc_feature (40)..(218): Pfam Name: HECT Pfam Description: HECT-domain (ubiquitin-transferase)
QLSLLSEEDLKGPIRVSFINEHGEEEAGIDGGGIFKDFMENITRAAFDVQYGLFKETADHLLYPNPASGLVHELHLQYFHFLGSLLGKAMYEGILVDLPFATFFLSKLKQKYNFLNDLPSLDPELYRHLLFLKHYNGDISELELYFVIVNNEYGEQCEEELLPGGRDMRVTNDNVITFIHLVANHRLNYQIRAQSTHFLRGFQQLIPKDWIDMFNEHE

SEQ ID NO: 50065 - DNA, 672 bp, Panicum virgatum
  misc_feature: Ceres CLONE 2055001
  misc_feature: Encodes the peptide sequence at SEQ ID NO. 50066
atccgctcatccagtcatcccctaaacctcgcaaaagcccaacccaaaccctagcacctctcatggatttcgctcgccggaaggcggccgcgctggccgcgctctcatcgccggcgccagacaagtccccgaagggcggagtcgacgctcccatcgccccgctcctcgaagtgctcaactcccacccggaccttttcactacctcctcctgctccggccgcgtctccgtcctagcgcagccgcaggaggtccaaggccagggcgccgccaagtcgaagaagaaggcgcggggcggcgggtgggtgtacgtgtctcacgatcccgctgacccggacgccgtggtggagcagctattcggccttagcggctcgagagcggcgggggacgagctggtgttcaggttcgagccgatgatcgtggcggtggagtgcaggaacgccgccgcagctgccgcgctcgttgccgctgcgatcagtgctgggttccgggaatcaggtatcacaagcttgcagaaacgagcaatggtggcaataagatgctcgattcgtatggaagtgccactggggcagactggtgaacttgttgtttatccagagtatgtccgttaccttgttagaattgccaactctaaaatgaaggcaaataaaaagcgaatgggtggatttctagatc

SEQ ID NO: 50066 - protein, 203 aa, Panicum virgatum
  misc_feature: Ceres CLONE 2055001
  misc_feature (1)..(203): Pfam Name: TYW3 Pfam Description: TYW3 like
MDFARRKAAALAALSSPAPDKSPKGGVDAPIAPLLEVLNSHPDLFTTSSCSGRVSVLAQPQEVQGQGAAKSKKKARGGGWVYVSHDPADPDAVVEQLFGLSGSRAAGDELVFRFEPMIVAVECRNAAAAAALVAAAISAGFRESGITSLQKRAMVAIRCSIRMEVPLGQTGELVVYPEYVRYLVRIANSKMKANKKRMGGFLD

SEQ ID NO: 50067 - DNA, 672 bp, Panicum virgatum
  misc_feature: Ceres CLONE 2055035
  misc_feature: Encodes the peptide sequence at SEQ ID NO. 50068
aaaaaaccaaacagaaggaccaaaggaaaaggccatcactggcggcaagagcgaagagggagatctcccgagagccgacgcctcgcgatttccggcatcaagataggacaaggtacatacagcagcgtttacaaggcacgtgatcttgagaatggaaaaattgtggctctgaagaaagttcggtttgccaatatggaccctgagagtgtccgatttatggcaagggaaattcacatcttaagaaggcttgatcatccaaatgttgtgaagcttgaaggtttggtgacgtcgcgcatgtcaagcagcttgtatcttgtatttgaatacatggagcatgaccttgcaggacttgcagctacacctggcttaaaatttacggaacctcaggtcaagtgttacatgcgacaactactttctggacttgaccattgtcataaccgtggtgttttgcaccgggatataaagggtgcaaatctcctacttgacaataatggcattcttaaaatagcagattttggtctagctacgttctttaatcccaaccaaaagcaacatttgacaagtcgtgtggtaacattgtggtaccggcctcctgagcttttgttgggtgccactaactatggcgctgctgttgatctctggagtgccggttgcattcttgctgagttgctg

SEQ ID NO: 50068 - protein, 223 aa, Panicum virgatum
  misc_feature: Ceres CLONE 2055035
  misc_feature (29)..(223): Pfam Name: Pkinase Pfam Description: Protein kinase domain
  misc_feature: SWISSPROT Homolog: EC 2.7.11.22 Cyclin-dependent kinase
KKPNRRTKGKGHHWRQERRGRSPESRRLAISGIKIGQGTYSSVYKARDLENGKIVALKKVRFANMDPESVRFMAREIHILRRLDHPNVVKLEGLVTSRMSSSLYLVFEYMEHDLAGLAATPGLKFTEPQVKCYMRQLLSGLDHCHNRGVLHRDIKGANLLLDNNGILKIADFGLATFFNPNQKQHLTSRVVTLWYRPPELLLGATNYGAAVDLWSAGCILAEL

SEQ ID NO: 50069 - DNA, 675 bp, Panicum virgatum
  misc_feature: Ceres CLONE 2055051
  misc_feature: Encodes the peptide sequence at SEQ ID NO. 50070
gagcatcgaccattattgcatcgcagcaacgcagagcacattgcagtgtagctagctactagctctgctcgttactaataaaacacgttccaagtttgctcagcgagagcacatcaggcatactcatcagagagctagctttcctgtccgatcccttcggcgtcgagtctccggccggccgccggcgacgaccgatctatcggcgatgggtggtgtagctaagatgcctgcagggctttgttggttattactgctaggtgtggtgttaacattcggtgttgcagctagcccggctcaggcatccagggctaatcactacgatttctttataaaggagacgaaggtcacccgtctctgccacgagaagaccatcctggccgtgaacggccagttccccgggccgaccatctacgcgcgcgcgggcgacgtcgtcgtcgtcaacgtctacaaccagggcaacaagaacatcaccctccactggcatggcgtggaccagccgcggaacccgtggttcgacgggcccgagtacatcacgcagtgccccatccagcccggcgccaacttcacctacaggatcatcttctccgaggaggagggcacggtctggtggcacgcgcacagcgacttcgaccgcgccaccgtgcacggcgccatcgtcgtccaccccaagcgcgg

SEQ ID NO: 50070 - protein, 156 aa, Panicum virgatum
  misc_feature: Ceres CLONE 2055051
  misc_feature (41)..(156): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 51311
  misc_feature: Useful for making plants with altered cell wall content and/or composition
  misc_feature: Functional homolog of the protein sequence given in SEQ ID NO 50535
  misc_feature: Useful for making plants with altered carbohydrate content
MGGVAKMPAGLCWLLLLGVVLTFGVAASPAQASRANHYDFFIKETKVTRLCHEKTILAVNGQFPGPTIYARAGDVVVVNVYNQGNKNITLHWHGVDQPRNPWFDGPEYITQCPIQPGANFTYRIIFSEEEGTVWWHAHSDFDRATVHGAIVVHPKR

SEQ ID NO: 50071 - DNA, 608 bp, Panicum virgatum
  misc_feature: Ceres CLONE 2055057
  misc_feature: Encodes the peptide sequence at SEQ ID NO. 50072
acgcacgccaatccaaagacgccctcctccgtcgccgcgccccttccaccatgcacacacacctctccgccccactggccactgtaccacctcctcctcctccatgccattgccactagatctaccaccgccaccgccaccatatctatcccgtcccggaaatattctgaacgcggcagctagcatagcagctgcagaaatcatggcccctacttcccctcctgccagcctactgctgctccagcgcctgttcccgttaacgctgctgctgctgctgttcattggcggcgctccagcgaccgcgcgcgccgccgccgacatgccgatgccggtgaacgaggaggtgctggggctggtggtcttcaagagcgcgctctccgacccgtccggcgcgctggccacgtggaccgagtccgacgccacgccctgcggctggcgctgcgtcgagtgcgacccggccacctcccgggtcctccgcctctccctctccggcctcgcgctatccggccccatgccgcgcggcctcgaccgcctccccgcgctccaggagctcaacctcgcccgcaacaacctctccggcccgctcccgccgggcctctccctgctca

SEQ ID NO: 50072 - protein, 135 aa, Panicum virgatum
  misc_feature: Ceres CLONE 2055057
  misc_feature (44)..(84): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPTSPPASLLLLQRLFPLTLLLLLFIGGAPATARAAADMPMPVNEEVLGLVVFKSALSDPSGALATWTESDATPCGWRCVECDPATSRVLRLSLSGLALSGPMPRGLDRLPALQELNLARNNLSGPLPPGLSLL

SEQ ID NO: 50073 - DNA, 663 bp, Panicum virgatum
  misc_feature: Ceres CLONE 2055063
  misc_feature: Encodes the peptide sequence at SEQ ID NO. 50074
atctggattgctcttggccgttgcttgctccaggaagaacactggacatggaattcttcaccgagtatggggaggcgagccagtttcagattgaagaggtcattggcaaggggagctatggggtagttgctgctgcaattgatactcacactggggagcgggttgcgataaaaaagataaaggatgtttttgggaatgtctcagatgctgctcgcattttgcgggaaatcaagcttcttcggctgcttcgccacccaaacatagtccagatcaaacacattatgttgccccctacccgaagggagttcagagatatctatgttgtttttgagctcatggagtctgacctgcatcaagtgatcaaagcaaatgataacctgactccagagcatcaccgttttttcttgtaccaactcctttgtgctctcaagtacatccatgcagcccatgtatttcatcgtgatttaaagcccaggaacatactggccaattcagacagcaaattaaagatttgtgactttggacttgcacgtgcatcatttaatgactccccttcagctatattttggacagattatgtggctacaaggtggtaccgagctcctgaattatgtggctcctttttctccattacacccctgcaattgatatttggagtatagg

SEQ ID NO: 50074 - protein, 204 aa, Panicum virgatum
  misc_feature: Ceres CLONE 2055063
  misc_feature (13)..(204): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MEFFTEYGEASQFQIEEVIGKGSYGVVAAAIDTHTGERVAIKKIKDVFGNVSDAARILREIKLLRLLRHPNIVQIKHIMLPPTRREFRDIYVVFELMESDLHQVIKANDNLTPEHHRFFLYQLLCALKYIHAAHVFHRDLKPRNILANSDSKLKICDFGLARASFNDSPSAIFWTDYVATRWYRAPELCGSFFSITPLQLIFGV

SEQ ID NO: 50075 - DNA, 673 bp, Panicum virgatum
  misc_feature: Ceres CLONE 2055075
  misc_feature: Encodes the peptide sequence at SEQ ID NO. 50076
agtggcgccgtgccgcactgcctgctgccatctcccaccataactctcacccgccccgcacgcctgcctgtctgtctgtccctcccgctctgctccgcacactcggtgcaggtgcagcgtcgtcccctgctctgctccccaccccacccagcgcccgcattgccgccggtgagcggaggcggaccggccgcggcggtgcgggggaggaaccaggaggaggaggggcgggaagagaggcggcaggatgttcgggcgggacccgtggggcggggcgctggagatctccaacgccgactcggcgacggacgacgaccggagccgggacctggaccgggcggcgctgatgcggcagctcgacgagacgcagcagagctggctcctcgccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcgtcatgatgatcgtcaagctcgtaccgcacaagcgcccgccgccgccgccgcccgaccagtacacgcaggcgctgcacaaggcgctcatgttcttcaacgcccagcgatctggtccgctgcccaaacacaacggcgtcagctggaggggcaattcctgcatg

SEQ ID NO: 50076 - protein, 142 aa, Panicum virgatum
  misc_feature: Ceres CLONE 2055075
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MFGRDPWGGALEISNADSATDDDRSRDLDRAALMRQLDETQQSWLLAGPGDQAGKKKKKYVDLGCVVLDRKIFMWTVGTILGLGVFIGFVMMIVKLVPHKRPPPPPPDQYTQALHKALMFFNAQRSGPLPKHNGVSWRGNSC

SEQ ID NO: 50077 - DNA, 685 bp, Panicum virgatum
  misc_feature: Ceres CLONE 2055086
  misc_feature: Encodes the peptide sequence at SEQ ID NO. 50078
ggaggcagagcggtcggctggtcgggccggcggcgacggtgacgcctcgctcgctcgctgtggccctacgcattccgcgcaggtgctagctgttgagctcacagaagaaaaaaagggagggctaccatggggatttcagctaagtggataaaatcacttgttgggctaagaaagcatgaaaaggagcgaaatgctgaaaccagcgccgggaggagctctggtgcccacttgctacacaaacaggatcattctgtagatacaaaaggtgctcatgcagctgaagaactcagagtacaagctgaaccattggctgctgaagcaaatacagagacaatatcaaattccacttcctcaccgagcacatcttttcaagtttctcagactgaacatggtacaaaggagtatcaggctgctgtggttattcagtccgccttccgagcattcctggctagacgtgctttacgggcgttaaaagggctagttagactccaggcacttgtaagaggtcatgctgtaagaaagcaagcagcagaaacacttcagtgcatgcaagcgctggtgagagctcaagctcgtgtgagagcaagacgagtccgtgtttctttggaaagccaagggacccaaaagaaacctcctgaaaagaatgttcatgaggaccatgttcaggatattgaggaagactggt

SEQ ID NO: 50078 - protein, 186 aa, Panicum virgatum
  misc_feature: Ceres CLONE 2055086
  misc_feature (93)..(113): Pfam Name: IQ Pfam Description: IQ calmodulin-binding motif
MGISAKWIKSLVGLRKHEKERNAETSAGRSSGAHLLHKQDHSVDTKGAHAAEELRVQAEPLAAEANTETISNSTSSPSTSFQVSQTEHGTKEYQAAVVIQSAFRAFLARRALRALKGLVRLQALVRGHAVRKQAAETLQCMQALVRAQARVRARRVRVSLESQGTQKKPPEKNVHEDHVQDIEEDW

SEQ ID NO: 50079 - DNA, 618 bp, Panicum virgatum
  misc_feature: Ceres CLONE 2055093
  misc_feature: Encodes the peptide sequence at SEQ ID NO. 50080
acgcaactctttgcaattcccctggctggcctgcttccatctcattccaaatccaccaccatgctgctgctcttcctcttcctcctcctgctcgctccgccgcctaccgctaaagccgccgcccaccaccaccacgccgccggcgacggcgtcgtcatctcccaggccgactaccagggcctccaggccatccgccacgacctctccgacccctacggcctcctccgctcctggaacgactccggcctcggcggcaccctctcccagcggggcctcggccagctcacccgactccgcaggctcagcctccacgacaacgccatcgcgggccccatcccggcatccctcggcttcctccccgacctccgcggcctctacctcttcaacaaccgcttctccggcgccctccccgcctccctcggcgcatgcctcgcgctccagtccttcgacgccagcaacaaccgcctcaccggcgccatcccggccgccatcgctaactccaccaagctcatccgcctcaacctcagccgcaacgcgctctctgctgacatccccgccgaggtcctcgcctccgcctccctcctcgtcctcgacctctcctacaacaacctctccggt

SEQ ID NO: 50080 - protein, 185 aa, Panicum virgatum
  misc_feature: Ceres CLONE 2055093
  misc_feature: SWISSPROT Homolog: EC 2.7.11.1 Non-specific serine/threonine protein kinase
MLLLFLFLLLLAPPPTAKAAAHHHHAAGDGVVISQADYQGLQAIRHDLSDPYGLLRSWNDSGLGGTLSQRGLGQLTRLRRLSLHDNAIAGPIPASLGFLPDLRGLYLFNNRFSGALPASLGACLALQSFDASNNRLTGAIPAAIANSTKLIRLNLSRNALSADIPAEVLASASLLVLDLSYNNLS

SEQ ID NO: 50081 - DNA, 658 bp, Panicum virgatum
  misc_feature: Ceres CLONE 2055127
  misc_feature: Encodes the peptide sequence at SEQ ID NO. 50082
acaacttgagtgagatctcattacattgccccaagtaagcgtttttcttgggccccaaggtgcatactgaatcactttggagacgatgcacagcggcagcaccgtcatgaccaccttctccttcaaaccacctcctccgtgcagcagcagcagcagcagcaggaggagctgccatgtccatattggtgccgctgctgcatcgccgccgccgctcatcaggcgatgcccgagcgtttcatggaggtggctgcagcggctgcggcggcacacctgcaggttgcaatgcggacagcagtcaccgcagcagaattccaaccttgttgatgaggatgatagccggctcagccagaacgccggcattttccatccatctatctggggagatttctttcttggctactccaacccagctgcagcttcatcgcaacagcagcagactcagatggcagaattagcagacagactgaaggaagaagtggccgaaatgatagcatgttcaactattggtggccagcatgggaggctacatctcatcgacacactggagcgtctgtgtttggatcacctgtttgaagaagagattagcgctgccttaccacagattgaggctgctggcgtcagtgactgtgatcttgggacgatagctctctggttttct

SEQ ID NO: 50082 - protein, 190 aa, Panicum virgatum
  misc_feature: Ceres CLONE 2055127
  misc_feature: SWISSPROT Homolog: EC 4.2.3.9 Aristolochene synthase
MHSGSTVMTTFSFKPPPPCSSSSSSRRSCHVHIGAAAASPPPLIRRCPSVSWRWLQRLRRHTCRLQCGQQSPQQNSNLVDEDDSRLSQNAGIFHPSIWGDFFLGYSNPAAASSQQQQTQMAELADRLKEEVAEMIACSTIGGQHGRLHLIDTLERLCLDHLFEEEISAALPQIEAAGVSDCDLGTIALWF

SEQ ID NO: 50083 - DNA, 717 bp, Panicum virgatum
  misc_feature: Ceres CLONE 2055131
  misc_feature: Encodes the peptide sequence at SEQ ID NO. 50084
atctccctcgtcgggtcctcattccacgctggctcctcttgactgactccgccgcaggttcccttctccctcccctcgcgacgccattctccctctcgcggtctcgccatggctcctccgagtgcctaggacaaggaaggggagatggagatcgaggaagcggccggcgagatggaggaaatggaggcccccgccgtcagcacggtggcggtggcgatcagcgggagcaggagcagcaggcacgcgctcaagtgggccctcgacaagttcgtccccgaagggagggtgctcttccggatcctccacgtgcgcccggcgatcaccatggtgcccaccccaatgggcaattttatcccaatctcacaagtacgggaagacgtagcatctgcatacaggaaagaagcagaatggcaagcgagcaatatgcttcttcctttcaagaagatgtgtgctcagaaaaaggtagaagctgaagctgttttactcgaatcagatgatgttgctgctgcaataagtgaagaaataggaaaattcaatatttccaaattagttttaggttcttcatcaaagaatatattccgaaggaaactcaaaggaagtaagactgccaccaaaatttctgagtccattccgagcttctgtacagcatatgtcatttcgaaaggcaaactttcattcgtgcggtcagctacatctgacggtgttgaaacacctcat

SEQ ID NO: 50084 - protein, 190 aa, Panicum virgatum
  misc_feature: Ceres CLONE 2055131
  misc_feature (17)..(172): Pfam Name: Usp Pfam Description: Universal stress protein family
MEIEEAAGEMEEMEAPAVSTVAVAISGSRSSRHALKWALDKFVPEGRVLFRILHVRPAITMVPTPMGNFIPISQVREDVASAYRKEAEWQASNMLLPFKKMCAQKKVEAEAVLLESDDVAAAISEEIGKFNISKLVLGSSSKNIFRRKLKGSKTATKISESIPSFCTAYVISKGKLSFVRSATSDGVETP

SEQ ID NO: 50085 - DNA, 617 bp, Panicum virgatum
  misc_feature: Ceres CLONE 2055143
  misc_feature: Encodes the peptide sequence at SEQ ID NO. 50086
ccgacacctctcgccacgcccacttcgccgcggcggacgccatgagcgcgggctggaggacgctgctgctgcgcatcggcgacaggtgccccgaatacggtggatccgcagaccacaaggagcacatcgaaacttgttatgccgtgataagtcgagaatatgaacattccagagacgctgtatttgagttcctccttcagtgtgcagaacaactgcctcacaagattcctttctttggagttttgattggtctgatgaacttagaaaatgaagattttgccaaggatattgtagataccacacaggccaaactacaggatgccttgcacaacgaaaatcgtgatagaattaggatattgctgcgatttctcagtggcctgatgtgcagcaaagttgtagtcccaaattcaatcatcgagacatttgagactctattatcatctgctgcaacaatattagatgaggagactggaaatccttcgtggcaaccacgtgctgacttttatgtttattgtattttggcttcccttccatggggtggtccagaattgtttgagcaagttccggatgagttcgagagagttttggttggtatacagtcttacataagtatcaga

SEQ ID NO: 50086 - protein, 191 aa, Panicum virgatum
  misc_feature: Ceres CLONE 2055143
  misc_feature (9)..(191): Pfam Name: MIF4G Pfam Description: MIF4G domain
MSAGWRTLLLRIGDRCPEYGGSADHKEHIETCYAVISREYEHSRDAVFEFLLQCAEQLPHKIPFFGVLIGLMNLENEDFAKDIVDTTQAKLQDALHNENRDRIRILLRFLSGLMCSKVVVPNSIIETFETLLSSAATILDEETGNPSWQPRADFYVYCILASLPWGGPELFEQVPDEFERVLVGIQSYISI

SEQ ID NO: 50087 - DNA, 606 bp, Panicum virgatum
  misc_feature: Ceres CLONE 2055146
  misc_feature: Encodes the peptide sequence at SEQ ID NO. 50088
accatcaagccaagcggcccaaaattccactccatcactcactagctctcgcgcttgcttccgatcccctgcgcgcagagagcatcagctccggcgagctctggccgccatgggtccgagggcgatggcgctcgtggcggcggcgatgatggcgtcggcggcggtggtgggcggggacttcgcggcggaccgggcggagtgctcggacaagctggtggggctggcgacgtgcctggcgtacgtgcaggacgaggcggcggcgccgacgccggactgctgcgcggggctcaacacggtgctgcagaccagccgcaagtgcctctgcgtgctcgtcaaggacaaggacgaccccaacctggggctcaagctcaacgtcaccaaggcgctggggctccccgccatctgcaaggccgccgccaacatctccgactgccccagtacgtgaccacctcaccattcctcaatcctcgtcatcatccaccggccagtaattggtggagtggttcttaattgtcatcttgatcatctatctctcagtcactttattagaatttgttacttatttatgagaacttgagaagtgagaatatattagcatcgaggcta

SEQ ID NO: 50088 - protein, 111 aa, Panicum virgatum
  misc_feature: Ceres CLONE 2055146
  misc_feature (31)..(108): Pfam Name: Tryp_alpha_amyl Pfam Description: Protease inhibitor/seed storage/LTP family
  misc_feature: Functional homolog of the protein sequence given in SEQ ID NO 50433
  misc_feature: Useful for making plants with altered carbohydrate content
MGPRAMALVAAAMMASAAVVGGDFAADRAECSDKLVGLATCLAYVQDEAAAPTPDCCAGLNTVLQTSRKCLCVLVKDKDDPNLGLKLNVTKALGLPAICKAAANISDCPST

SEQ ID NO: 50089 - DNA, 639 bp, Panicum virgatum
  misc_feature: Ceres CLONE 2055157
  misc_feature: Encodes the peptide sequence at SEQ ID NO. 50090
gacgcgcccccgcccccgcgcccgcagcctcctcgctctcccccgcgcgcgatccccacgcacgcacgcccgcccccggcctccccgctgcagatggcgacgccggccgtgggcgccgcgtgcctcctcctcgcgcgggccgccggggccccggggcccaggcggggcggcggcggcggcgaccaggcgcgcccgcggcggccccagcgggcggtgcgccgccgctgcgtcgcggagctcagcagggagggccccgcgccgcgcccgatgccgcagctggcgccaccgctcgtgcccggctccctcgcgccgccgcgcgacgagcccgagcccgcgcgggagccggcgtcgacgccgccgcccgtgcccgacggcggcctgggggacctcgatctcggcctcgaactggaagagattgctgaaaattccatcaacaacacagtagttgtggaaagtgagcaagactctaagatcatggttggaaaggagcaagaatctgagatcatgattgggaaggagcaagctcgagctaaagtaacacatagcattgtctttgtaactggtgaagcttgtccttatgcaaagtcagggggtctaggagatgtttgtggttcactacctgttgctcttgctgctcgt

SEQ ID NO: 50090 - protein, 181 aa, Panicum virgatum
  misc_feature: Ceres CLONE 2055157
  misc_feature (87)..(181): SWISSPROT Homolog: EC 2.4.1.21 Starch synthase
  misc_feature (151)..(181): SWISSPROT Homolog: EC 2.4.1.242 NDP-glucose--starch glucosyltransferase
MATPAVGAACLLLARAAGAPGPRRGGGGGDQARPRRPQRAVRRRCVAELSREGPAPRPMPQLAPPLVPGSLAPPRDEPEPAREPASTPPPVPDGGLGDLDLGLELEEIAENSINNTVVVESEQDSKIMVGKEQESEIMIGKEQARAKVTHSIVFVTGEACPYAKSGGLGDVCGSLPVALAA

SEQ ID NO: 50091 - DNA, 616 bp, Panicum virgatum
  misc_feature: Ceres CLONE 2055187
  misc_feature: Encodes the peptide sequence at SEQ ID NO. 50092
ccacgcagaggagggagaagaggacgagcggtttgcccgccccgtgactgcctccgcagaaggcgacgcaactgacaccgacgcggtcgtcccgtcttccttctccagtcctcctcctcgtcgcgcgatggcttcggccgcctccgccggggtcgcggcgctcgggatctccggcgccgacggcgagtgggcggccgcgtgcccacccctgcggcggaacctgcacctgctcgcgcccgacgaggttgaacttgcaaaaatgctgttgaatgagggccaaatgcacctgtttgaacactggcctgaaccaggtgttgatgatgacaagaaaaaaagcatctttgatcaggttcgtcgacttaattcaagctatcctggagggctggcatcgtacatccagaatgccaaaaaacttttggcagattcaaaggcaggaaaaaatccatatgatggttttactccttctgttccttcaggggaggtattgacctttggcgatgacaattttgtttcactggaagcagctggggtaaaagaagcacggagtgctgcatttgttcttgtagctggagggcttggtgaaagacttggctataaaggaattaaggtagcactc

SEQ ID NO: 50092 - protein, 162 aa, Panicum virgatum
  misc_feature: Ceres CLONE 2055187
  misc_feature: SWISSPROT Homolog: EC 2.7.7.64 UTP-monosaccharide-1-phosphate uridylyltransferase
MASAASAGVAALGISGADGEWAAACPPLRRNLHLLAPDEVELAKMLLNEGQMHLFEHWPEPGVDDDKKKSIFDQVRRLNSSYPGGLASYIQNAKKLLADSKAGKNPYDGFTPSVPSGEVLTFGDDNFVSLEAAGVKEARSAAFVLVAGGLGERLGYKGIKVA

SEQ ID NO: 50093 - DNA, 674 bp, Panicum virgatum
  misc_feature: Ceres CLONE 2055189
  misc_feature: Encodes the peptide sequence at SEQ ID NO. 50094
actagctccacacttgctcaccagctcctttcagtgctgctgagaataagccagctctccctcctctcgtcttcaatctcagtcttcatcccaggagacagctgaaatgaaagaaagttctcagaagcttggagcacaacttgcctgttgcttcctccccttttctagtaacgcagcagtcaagcttcaagagagcttctgttttgaatcaacgaaatggattgagtacatcagccgtgctccaattcctgaaaaaacaacaaactgaggacactttcagaaagcatgaagctgttagtttttgctctagttttattgggatgcctacattcttctactgctgctgagttccaagttgaagcactgtatgaaatgaggcaacaactattgggatcagtggtgtgcttaatgactggaaggataatcaattgagcccctgctattgggatcatgttacttgtcaggacaacaaagttacaatgataagtttgtcctcatttgggttaacaggaactttgtcacccagcattgcaaagctaacaactttacaacagctgatattggatggcaacaacataactggagcgatccctcaggagtttgggaacctttcaagcttgacaactataaatcttcaaaaaataatttaaatggctcgatactggacactctgg

SEQ ID NO: 50094 - protein, 56 aa, Panicum virgatum
  misc_feature: Ceres CLONE 2055189
  misc_feature: Functional homolog of the protein sequence given in SEQ ID NO 50524
  misc_feature: Useful for making plants with modulated nitrogen use efficiency
MISLSSFGLTGTLSPSIAKLTTLQQLILDGNNITGAIPQEFGNLSSLTTINLQKII

SEQ ID NO: 50095 - DNA, 696 bp, Panicum virgatum
  misc_feature: Ceres CLONE 2055198
  misc_feature: Encodes the peptide sequence at SEQ ID NO. 50096
gctgtatcccccacctccgtcccccaccccactcccaccccaccagcgatggcgaccgccgaggccggcccgaccacgggcaagcccgcctgcgccgttaccttcggccgctccaccctcctcggccgccacctcgccgccgcgctcgccgcctccggccgctggtcggccgtcgccgtcctcgacccttccccttcccctcccccaccgccggcctcccccctagtccgccaccacgccgtcgacctctccgaccccgcgcgactcgcctccgcgctcgccggcgccgcggccgtcttccatgtggacgcgacgacggcagccgcccccgggagcgacgggtccttcctctccctccaccgcctcgctgccgagggcacgaggcggctcctcgcggcctgccgcgcggccggcgtggggagggttgtgtacaccggctcggccgacgtggtggccgccggcccccgggatgtagtcaatgccgacgaggactccgtgtcctaccctgacaagtttgggaacgcagtgagcgagctgagggcgcaggtggagatgatggtgctgagtgcggacggggtggacggggtgcggacgtgcgtgctgcgcccaagcaatctgttcgggcctggcgattcgagcctggtgcggtttgttgctggatatgcaaggtctcccttgggcaagtttgtaataggt

SEQ ID NO: 50096 - protein, 215 aa, Panicum virgatum
  misc_feature: Ceres CLONE 2055198
  misc_feature (16)..(214): Pfam Name: 3Beta_HSD Pfam Description: 3-beta hydroxysteroid dehydrogenase/isomerase family
  misc_feature: SWISSPROT Homolog: EC 1.1.1.170 Sterol-4-alpha-carboxylate 3-dehydrogenase (decarboxylating)
MATAEAGPTTGKPACAVTFGRSTLLGRHLAAALAASGRWSAVAVLDPSPSPPPPPASPLVRHHAVDLSDPARLASALAGAAAVFHVDATTAAAPGSDGSFLSLHRLAAEGTRRLLAACRAAGVGRVVYTGSADVVAAGPRDVVNADEDSVSYPDKFGNAVSELRAQVEMMVLSADGVDGVRTCVLRPSNLFGPGDSSLVRFVAGYARSPLGKFVI

SEQ ID NO: 50097 - DNA, 589 bp, Panicum virgatum
  misc_feature: Ceres CLONE 2055211
  misc_feature: Encodes the peptide sequence at SEQ ID NO. 50098
gctagttgcctcgccagttgcgtcgctgctcggctcggctcccataccaccagtccaccaccaccccgtcatccatctcctcctccgcgcccgcctccgcctccgcttttccgtccactcctccccctccccgtccacgcctccctccctctctctcaagcgcgcgccccattgcttctcggatctgggcgggcgggcggcggcctcgcctcgcgctcccggcggttgcgatctgacccgggtgggggcgcgcggctgctggcgagccgaatggtgtgatcggcccggccggggaccgggagcgaggcgatgcggcgggctccggagctcccgctgctgctggcggcggcgctcctcgcattggcggcggcgcccgggctcgcgcgcgcggccaccgacgcggccgacgtctctgccataaatggattgtacgttgcactgggatcgccaactcttcctggatggactggaaatggtggagacccctgtggtgagctctggcagggtatcgtgtgtactggctctactataactggaatctgggcagtttagggaacttcacttcgatcatcaccataaatcttagtaa

SEQ ID NO: 50098 - protein, 80 aa, Panicum virgatum
  misc_feature: Ceres CLONE 2055211
  misc_feature: Functional homolog of the protein sequence given in SEQ ID NO 50266
  misc_feature: Useful for making plants with altered cell wall content and/or composition
MRRAPELPLLLAAALLALAAAPGLARAATDAADVSAINGLYVALGSPTLPGWTGNGGDPCGELWQGIVCTGSTITGIWAV

SEQ ID NO: 50099 - DNA, 695 bp, Panicum virgatum
  misc_feature: Ceres CLONE 2055225
  misc_feature: Encodes the peptide sequence at SEQ ID NO. 50100
acatactctatcccctgcctttcatcattccttcttcatctcttatcttccaaacacatacggacacacagaagctgaacgggagaagagatagatacaaggttacaaacacaaagatgaggcttggtctaaaaggtctcaccttcctgcttctccttgtcttgcttgttctgtgctccagcatttgtctatgcgatgcgagaagcgggaagcattggaggcgaagcagagcgacctccacctctatgctaagaaaagggaaaccaaagagcagcagttcccacaagcaaaacggcaaaggaattcagaatccataccagccaagtccgagcacaagccctgtcagcccaagcagaagccctgtccatggcaaaggaggccagggtccaacaatgccaacaccaggcggtggaagtggatgtacagtgccacctccaccactgctgcagccgcctccaccgccgtctccaccggcagagcaggacacagtcttcaacgtggtcgattttggagccaagggtgatggggttacggatgatactcaggcttttgaagcagcatgggcagcagcatgcaaggtggaggcatctacggttcttataccatatgaactcgagtttgtcgttggcccaatctcattttctgggccttactgtaaaccaacattctattccaggtaattccacttcaaaacc

SEQ ID NO: 50100 - protein, 187 aa, Panicum virgatum
  misc_feature: Ceres CLONE 2055225
  misc_feature: SWISSPROT Homolog: EC 3.2.1.15 Polygalacturonase
  misc_feature: Functional homolog of the protein sequence given in SEQ ID NO 50988
  misc_feature: Useful for making plants with altered carbohydrate content
MRLGLKGLTFLLLLVLLVLCSSICLCDARSGKHWRRSRATSTSMLRKGKPKSSSSHKQNGKGIQNPYQPSPSTSPVSPSRSPVHGKGGQGPTMPTPGGGSGCTVPPPPLLQPPPPPSPPAEQDTVFNVVDFGAKGDGVTDDTQAFEAAWAAACKVEASTVLIPYELEFVVGPISFSGPYCKPTFYSR

SEQ ID NO: 50101 - DNA, 650 bp, Panicum virgatum
  misc_feature: Ceres CLONE 2055235
  misc_feature: Encodes the peptide sequence at SEQ ID NO. 50102
gtcgagcccaaagccccaaacaggcaaagctcccctcccctccacgccccatctccggcgagctagggtttccgcccccctcctcgcctccccgccgctcccgctcggcaatcccgccctccccggatctccagccatgtacggcggagacgaggtctcggcaatcgtcatagacgtgggctcctacagctgcaaggcgggctacgccggcgacgacacccccaaggccgtcttcccgtcggtgagagaaatgcccccctcctgctgcttccaaacacctcatgttccgctgtcgtctcgcagtttcgctttgggctcacagtctgcccacttctgcggtatctgtaagccgttagccgcgaaatgcagttccggatagtttgttttgggctggcgaattagcatctagtctgaaagttcgtgaggtaattttggctgttgacttcaaatgctgggttcgaacttcaaacatgacacgctgctgcttcacttcgttctgtgaacatgtatgctgtgttctcttacaattttggataggtccggctgtccggctcaatttgtgaatttcgcaacagacattaacttgcacatagattctggcttcgtatatggatattttagctgattgcagggttaattagtgcttcagt

SEQ ID NO: 50102 - protein, 80 aa, Panicum virgatum
  misc_feature: Ceres CLONE 2055235
  misc_feature: SWISSPROT Homolog: EC 2.7.10.2 Non-specific protein-tyrosine kinase
MYGGDEVSAIVIDVGSYSCKAGYAGDDTPKAVFPSVREMPPSCCFQTPHVPLSSRSFALGSQSAHFCGICKPLAAKCSSG

SEQ ID NO: 50103 - DNA, 579 bp, Panicum virgatum
  misc_feature: Ceres CLONE 2055238
  misc_feature: Encodes the peptide sequence at SEQ ID NO. 50104
ctctctctccgcctcccccattcctcttcccctgcgatccgaggccgcacccgcagccgcagggaggagaagcgatcacctgatcaggcgaggcctcgcgatctcgcgcaggagcggagatggggctcacgttcacgaagctgttcagccgcctcttcgccaagaaggagatgaggatcctcatggttggtctcgacgcggctggtaagaccaccatcctctacaagctcaagctcggcgagatcgtcaccaccatccccaccataggatttaatgttgaaactgttgagtacaagaacattagcttcactgtttgggatgttggtggtgaggacgaggtgcgtccgctgggggggcacgacgtccagaacacccagggcctcatttttgttgtggacagcaacgacagagagcgtgttattgaggccagagatgagctccatcgtatgctgaatgaggacgagctccgtgatgctgtgcttctggtgtttgcaaacaaacaagatcttcctaatgccatgaacgctgctgaaatcaccgacaagcttggcctgcactccctgcgccagcggcactggg

SEQ ID NO: 50104 - protein, 153 aa, Panicum virgatum
  misc_feature: Ceres CLONE 2055238
  misc_feature (5)..(153): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLTFTKLFSRLFAKKEMRILMVGLDAAGKTTILYKLKLGEIVTTIPTIGFNVETVEYKNISFTVWDVGGEDEVRPLGGHDVQNTQGLIFVVDSNDRERVIEARDELHRMLNEDELRDAVLLVFANKQDLPNAMNAAEITDKLGLHSLRQRHW

SEQ ID NO: 50105 - DNA, 645 bp, Panicum virgatum
  misc_feature: Ceres CLONE 2055259
  misc_feature: Encodes the peptide sequence at SEQ ID NO. 50106
accacgcttccccctgctcattcctcggctcaccatcatgcgtcctcctcatcaccttctcctcggactcctcctcctcctctgcctgcgcgcgccgccgcgccccgccgccgccgcggacgcggacacggacacggtgtcccccggcaacgggctcgccggcaccggcgccaggctcgtctccaacaacagcaagttcgcgctcggcttcttcaaggccgacagcaggtcccccaacacctacctcggcatatggttcaacaaggtccccaagctcaccccgctctggagcgccaacggcgacagccccgtcgtcgaccccgcctcgccggagctcgccatctccggcgacgggaacctggtcatccgcgaccgggccacggccgccggctccgtcgtctggtccacccgcgccaacaccaccaccacccgcaccgtcgccgtgctcctcgacgacggcaacctcgtcctgcgcagcgccgccaacgcgtccgacgtcttctggcagagcttcgaccacccgacggacaccctcttcgccggcgccaagatcggctgggacaagcgcaccggcgtcaaccgccgcctggtttccaggaagaattcggtcgaccaggcccccggcctctactccctggagttcga

SEQ ID NO: 50106 - protein, 202 aa, Panicum virgatum
  misc_feature: Ceres CLONE 2055259
  misc_feature (79)..(194): Pfam Name: B_lectin Pfam Description: D-mannose binding lectin
MRPPHHLLLGLLLLLCLRAPPRPAAAADADTDTVSPGNGLAGTGARLVSNNSKFALGFFKADSRSPNTYLGIWFNKVPKLTPLWSANGDSPVVDPASPELAISGDGNLVIRDRATAAGSVVWSTRANTTTTRTVAVLLDDGNLVLRSAANASDVFWQSFDHPTDTLFAGAKIGWDKRTGVNRRLVSRKNSVDQAPGLYSLEF

SEQ ID NO: 50107 - DNA, 699 bp, Panicum virgatum
  misc_feature: Ceres CLONE 2055262
  misc_feature: Encodes the peptide sequence at SEQ ID NO. 50108
gaacacgcactgcacgcaggagtaggacacagcagcaggcaggcaggcagacacacctcctctcccctctccaccctcttcgctccgcctccggcctccctccggcaatggaagcgcctccaccttctccgccctccctattgctcctcctgctgcttctcgtctcctccccttcgacttcattggcgctcctcaccccccagggcgtcaactatgaagtgcaagctctaatgacaatcaagaacctgctcacggacccccatggcgtgctcaagaactgggacaaggactccgtcgatccctgtagctggaccacggtcacctgctcgccggacaaactcgtcactggactggaggccccaagccagagcctctctggcatgctctccccaaccataggcaacctcaccaatcttcagatcgttctcctgcagaacaacaacatcactggcccaatcccagcagagattggcaagctttcaaagctcaagacacttgatctctccagcaaccacctgtatggtggaatccccaccactgtgggccaccttcagagcctgcagtacttgaggctcaacaacaacaccctgtctggtccattcccttcagcatcagctaatttgtcccagcttgttttcctagacttgtcatataataacctgagtggtccaataccaggattcttgggcaagaacattc

SEQ ID NO: 50108 - protein, 197 aa, Panicum virgatum
  misc_feature: Ceres CLONE 2055262
  misc_feature (34)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Functional homolog of the protein sequence given in SEQ ID NO 50524
  misc_feature: Useful for making plants with modulated nitrogen use efficiency
MEAPPPSPPSLLLLLLLLVSSPSTSLALLTPQGVNYEVQALMTIKNLLTDPHGVLKNWDKDSVDPCSWTTVTCSPDKLVTGLEAPSQSLSGMLSPTIGNLTNLQIVLLQNNNITGPIPAEIGKLSKLKTLDLSSNHLYGGIPTTVGHLQSLQYLRLNNNTLSGPFPSASANLSQLVFLDLSYNNLSGPIPGFLGKNI

SEQ ID NO: 50109 - protein, 256 aa, Arabidopsis thaliana; identical to SEQ ID NO: 9575
  misc_feature: Useful for making plants with modulated nitrogen use efficiency
  misc_feature (245)..(245): Xaa is any aa, unknown, or other

SEQ ID NO: 50110 - protein, 73 aa, Arabidopsis thaliana
  misc_feature: Useful for making plants with modulated salt sensitivity
MEVFRSFDRDGNGSITAAELAGSMAKMGHPLTYRELTEMMTEADSNGDGVISFNEFSHIMAKSAADFLGLTAS

SEQ ID NO: 50111 - protein, 125 aa, Arabidopsis thaliana
  misc_feature: Useful for biocontainment applications
MGSMFSGNRMSKEEMEVVVNKAKEIVSAYPVVVFSKTYCGYCQRVKQLLTQLGATFKVLELDEMSDRGEIQSALSEWTGQTTVPNVFIKGKHIGGCDRVMETNKQGKLVPLLTEAGAIANNSSQL

SEQ ID NO: 50112 - protein, 190 aa, Arabidopsis thaliana
  misc_feature: Useful for making plants with modulated biomass
MGDAIDLSGDGGVLKKIVRSAKPDAISPSDDLPVVDVHYEGILAEDEKVFDTTREDNLVFSFELGTGSVIRSWDIALKTMKVGEVAKITCKPEYAYGRAGSPPDIPPDATLIFEVELVACRPRKGASVGSVSEERARLEDLKKQREIAAAAKEDDKKKREEAKAAAAARIQAKLDAKKGPGKGKGKGKAK

SEQ ID NO: 50113 - protein, 286 aa, Arabidopsis thaliana; identical to SEQ ID NO: 9411
  misc_feature: Useful for making plants with modulated oxidative stress sensitivity

SEQ ID NO: 50114 - protein, 275 aa, Arabidopsis thaliana
  misc_feature: Useful for making plants with modulated water use efficiency
MATTTAAAAGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIEFQRNSELDPEKRIYPGGYFDPLGLAADPEKLDTLKLAEIKHSRLAMVAFLIFALQAAFTGKGPVSFLATFNN

SEQ ID NO: 50115 - protein, 275 aa, Arabidopsis thaliana
  misc_feature: Useful for making plants with modulated biomass
  misc_feature: Useful for making plants with modulated drought sensitivity
  misc_feature: Useful for making plants with modulated phosphate use efficiency
MATTTAAAAGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIELQRNSELDPEKRIYPGGYFDPLGLAADPGKLDTLKLAEIKHSRLAMVAFLIFALQAAFTGKGPVSFLATFNN

SEQ ID NO: 50116 - protein, 216 aa, Arabidopsis thaliana; identical to SEQ ID NO: 9627
  misc_feature: Useful for making plants with modulated nitrogen use efficiency

SEQ ID NO: 50117 - protein, 69 aa, Arabidopsis thaliana
  misc_feature: Useful for making plants with altered cell wall content and/or composition
MADWGPVLIAVILFVVLSPGLLFQIPAGGRVVEFGNMQTSGASILVHAIIFFGLITIFTIAINVHIYSG

SEQ ID NO: 50118 - protein, 148 aa, Arabidopsis thaliana; identical to SEQ ID NO: 9309
  misc_feature: Useful for biocontainment applications

SEQ ID NO: 50119 - protein, 348 aa, Arabidopsis thaliana
  misc_feature: Useful for making plants with modulated low light sensitivity
MMTPGGSGRLRPLPTAMYAGYSGTASSWVAKTSVSASGKRIQREMAELNIDPPPDCSAGPKGDNLYHWIATIIGPSGTPYEGGIFFLDIIFPSDYPFKPPKLVFKTRIYHCNVDTAGDLSVNILRDSWSPALTITKVLQAIRSIFLKPEPYSPALPVIARLYLTDREKHDEVAKEWTLRFAKMYAGYSGTASSWVAKTSVSASGKRIQREMAELNIDPPPDCSAGPKGDNLYHWIATIIGPSGTPYEGGIFFLDIIFPSDYPFKPPKLVFKTRIYHCNVDTAGDLSVNILRDSWSPALTITKVLQAIRSIFLKPEPYSPALPVIARLYLTDREKHDEVAKEWTLRFAK

SEQ ID NO: 50120 - protein, 182 aa, Arabidopsis thaliana
  misc_feature: Useful for making plants with modulated light quality sensitivity
MMTPGGSGRLRPLPTAMYAGYSGTASSWVAKTSVSASGKRIQREMAELNIDPPPDCSAGPKGDNLYHWIATIIGPSGTPYEGGIFFLDIIFPSDYPFKPPKLVFKTRIYHCNVDTAGDLSVNILRDSWSPALTITKVLQAIRSIFLKPEPYSPALPVIARLYLTDREKHDEVAKEWTLRFAK

SEQ ID NO: 50121 - protein, 138 aa, Arabidopsis thaliana; identical to SEQ ID NO: 9648
  misc_feature: Useful for making plants with modulated nitrogen use efficiency

SEQ ID NO: 50122 - protein, 1065 aa, Arabidopsis thaliana
  misc_feature: Useful for making plants with modulated biomass
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVSDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLPAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 50123 - protein, 1174 aa, Arabidopsis thaliana; identical to SEQ ID NO: 9310
  misc_feature: Useful for making plants with altered cell wall content and/or composition

SEQ ID NO: 50124 - protein, 1078 aa, Panicum virgatum; identical to SEQ ID NO: 4798
  misc_feature: Useful for making plants with altered carbohydrate content

SEQ ID NO: 50125 - protein, 522 aa, Zea mays
  misc_feature: Useful for making plants with modulated plant growth and development
MSNGPFILNLDCDHYVYNSQAFREGMCFMMDRGGDRIGYVQFPQRFEGIDPSDRYANHNTVFFDVNMRALDGLMGPVYVGTGCLFRRVALYGFDPPRSKEHGGCCSCCFPQRRKIKASAAAPEETRALRMADFDEDEMNMSSFPKKFGNSSFLIDSIPIAEFQGRPLADHPGVKNGRPPGALTVPRDLLDASTVAEAVSVISCWYEDKTEWGHRVGWIYGSVTEDVVTGYRMHNRGWKSVYCVTKRDAFHGTAPINLTDRLHQVLRWATGSVEIFFSRNNALLASRRMKFLQRIAYLNVGIYPFTSIFLIVYCFLPALSLFSGQFIVKTLNVTFLTYLLVITLTLCLLAVLEIKWSGISLEEWWRNEQFWLIGGTSAHLAAVLQGLLKVVAGIEISFTLTSKSGGDDVDDEFADLYIVKWTSLMIPPIVIMMVNLIGIAVGFSRTIYSEIPQWSKLLGGVFFSFWVLAHLYPFAKGLMGRRGRTPTIVFVWAGLLSITISLLWVAINPPSQNQQIGGSFTFP

SEQ ID NO: 50126 - protein, 193 aa, Panicum virgatum; identical to SEQ ID NO: 9937
  misc_feature: Useful for making plants with altered carbohydrate content

SEQ ID NO: 50127 - protein, 200 aa, Arabidopsis thaliana
  misc_feature: Useful for making plants with modulated heat sensitivity
MSFTGTQQKCRACEKTVYPVELLSADGISYHKACFKCSHCKSRLQLSNYSSMEGVVYCRPHFEQLFKESGSFSKNFQSPAKPLTDKPTPELNRTPSRLAGMFSGTQDKCATCTKTVYPIEKVTVESQCYHKSCFKCSHGGCPISPSNYAALEGILYCKHHFAQLFKEKGSYNHLIKSASIKRATAAATAAAAAVAAVPES

SEQ ID NO: 50128 - protein, 570 aa, Panicum virgatum; identical to SEQ ID NO: 17845
  misc_feature: Useful for making plants with altered carbohydrate content

SEQ ID NO: 50129 - protein, 154 aa, Arabidopsis thaliana
  misc_feature: Useful for making plants with modulated oxidative stress sensitivity
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 50130 - protein, 325 aa, Arabidopsis thaliana; identical to SEQ ID NO: 9581
  misc_feature: Useful for biocontainment applications
  misc_feature: Useful for making plants with modulated flowering time

SEQ ID NO: 50131 - protein, 77 aa, Triticum aestivum
  misc_feature: Useful for making plants with modulated heat sensitivity
MAAVDLSKLVKEKRFWAASFLIAWAAALQGHMMWLKRQDAFKDKFGDPEAPNKVTEQGHQQPPAGEQGELTADAEIR

SEQ ID NO: 50132 - protein, 46 aa, Arabidopsis thaliana; identical to SEQ ID NO: 9509
  misc_feature: Useful for making plants with modulated biomass

SEQ ID NO: 50133 - protein, 153 aa, Zea mays; identical to SEQ ID NO: 9433
  misc_feature: Useful for making plants with modulated nitrogen use efficiency

SEQ ID NO: 50134 - protein, 77 aa, Arabidopsis thaliana; identical to SEQ ID NO: 9399
  misc_feature: Useful for making plants with modulated cold sensitivity
  misc_feature: Useful for making plants with modulated flowering time

SEQ ID NO: 50135 - protein, 150 aa, Arabidopsis thaliana; identical to SEQ ID NO: 9712
  misc_feature: Useful for making plants with modulated biomass

SEQ ID NO: 50136 - protein, 44 aa, Arabidopsis thaliana
  misc_feature: Useful for making plants with modulated nitrogen use efficiency
MGHSNVWNSHPKKYGPGSRLCRVCGNSHGSDPEVWFELLQTVFP

SEQ ID NO: 50137 - protein, 143 aa, Arabidopsis thaliana; identical to SEQ ID NO: 9265
  misc_feature: Useful for making plants with altered oil content
  misc_feature: Useful for making plants with modulated cold sensitivity

SEQ ID NO: 50138 - protein, 135 aa, Glycine max
  misc_feature: Useful for making plants with modulated nitrogen use efficiency
MGAILSALTGGAATAATSSPESSASRVQSFHSSARWQLHFNELKETNKLVVIDFSASWCGPCKFIEPAIHAMSEKFTDVDFVKIDVDELPDVAKEFNVEAMPTFVLCKKGKEVDKVVGAKKDELEKKIEKHRSQS

SEQ ID NO: 50139 - protein, 92 aa, Arabidopsis thaliana [sequence omitted]

SEQ ID NO: 50140 - protein, 68 aa, Arabidopsis thaliana; identical to SEQ ID NO: 9418
  misc_feature: Useful for making plants with modulated nitrogen use efficiency

SEQ ID NO: 50141 - protein, 450 aa, Arabidopsis thaliana
  misc_feature: Useful for making plants with altered cell wall content and/or composition
MREIISIHIGQAGIQVGNSCWELYCLEHGIQPDGMMPSDTTVGVAHDAFNTFFSETGAGKHVPRAVFVDLEPTVIDEVRTGTYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDITEFQTNLVPYPRIHFMLSSYAPVISAAKAYHEQLSVPEITNAVFEPASMMAKCDPRHGKYMACCLMYRGDVVPKDVNAAVGTIKTKRTVQFVDWCPTGFKCGINYQPPTVVPGGDLAKVQRAVCMISNNTAVAEVFSRIDHKFDLMYAKRAFVHWYVGEGMEEGEFSEAREDLAALEKDYEEVGAEGGDDEEDEGEDY

SEQ ID NO: 50142 - protein, 133 aa, Arabidopsis thaliana
  misc_feature: Useful for making plants with altered lignin content
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGGHGGGGHYGGGGHGLNEPVQTKPGV

SEQ ID NO: 50143 - protein, 120 aa, Arabidopsis thaliana; identical to SEQ ID NO: 9328
  misc_feature: Useful for making plants with altered alkaloid content
  misc_feature: Useful for making plants with altered lignin content

SEQ ID NO: 50144 - protein, 110 aa, Arabidopsis thaliana
  misc_feature: Useful for making plants with altered lignin content
  misc_feature: Useful for making plants with altered terpenoid content
MASKALILLGLFSVLLVVSEVSAARQSGMVKPESEETVQPEGYGGGHGGHGGHGGGGGHGHGGHNGGGGHGLDGYGGHYGGGGGGYGGGGGHHGGGGHGLNEPVQTKPGV

SEQ ID NO: 50145 - protein, 143 aa, Arabidopsis thaliana
  misc_feature: Useful for making plants with modulated heat sensitivity
MAMTAAAVPSSGSFQKQDEEWRAVLSPEQFRVLRLKGTDKRGKGEFTKKFEEGTYSCAGCGTALYKSTTKFDSGCGWPAFFDAIPGAIKQTPEAGGRRMEITCAVCDGHLGHVFKGEGYSTPTDQRHCVNSVSLKFASADSSK

SEQ ID NO: 50146 - protein, 246 aa, Glycine max
  misc_feature: Useful for making plants with altered terpenoid content
MVFEETELRLGLGLCLPGNGTTATTEAAAAELGVRKRGFSETETDETATVDLMLNLSPKEAAAADGADPREKPKTSPKEKTLLLPDPAKPPAKAQVVGWPPVRSFRKNMFAAQKSSGGEESEKSSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 50147 - protein, 243 aa, Arabidopsis thaliana
  misc_feature: Useful for making plants with modulated nitrogen use efficiency
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAIGLAPRAMEKYCKNRS

SEQ ID NO: 50148 - protein, 228 aa, Arabidopsis thaliana
  misc_feature: Useful for making plants with altered alkaloid content
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 50149 - protein, 89 aa, Arabidopsis thaliana
  misc_feature: Useful for making plants with altered lignin content
  misc_feature: Useful for making plants with modulated nitrogen use efficiency
MEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 50150 - protein, 181 aa, Arabidopsis thaliana; identical to SEQ ID NO: 9285
  misc_feature: Useful for making plants with altered alkaloid content
  misc_feature: Useful for making plants with altered lignin content

SEQ ID NO: 50151 - protein, 117 aa, Arabidopsis thaliana; identical to SEQ ID NO: 9481
  misc_feature: Useful for making plants with modulated heat sensitivity

SEQ ID NO: 50152 - protein, 265 aa, Panicum virgatum; identical to SEQ ID NO: 16924
  misc_feature: Useful for making plants with altered carbohydrate content

SEQ ID NO: 50153 - protein, 128 aa, Arabidopsis thaliana; identical to SEQ ID NO: 9312
  misc_feature: Useful for making plants with modulated heat sensitivity

SEQ ID NO: 50154 - protein, 97 aa, Arabidopsis thaliana
  misc_feature: Useful for making plants with modulated nitrogen use efficiency
MALSTSIRSVSKIIASSEASVSRSVTRSFHSTGVKKMSGGGHGGYDEYYLHAKHMYNLDRMKYQALKMSLGVFTAFSIGVGVPIFAVVFQQRKTQSG

SEQ ID NO: 50155 - protein, 152 aa, Arabidopsis thaliana; identical to SEQ ID NO: 9550
  misc_feature: Useful for biocontainment applications

SEQ ID NO: 50156 - protein, 203 aa, Zea mays; identical to SEQ ID NO: 9453
  misc_feature: Useful for making plants with modulated biomass

SEQ ID NO: 50157 - protein, 167 aa, Arabidopsis thaliana; identical to SEQ ID NO: 9425
  misc_feature: Useful for making plants with modulated nitrogen use efficiency

SEQ ID NO: 50158 - protein, 186 aa, Arabidopsis thaliana
  misc_feature: Useful for making plants with modulated heat sensitivity
MAAFTCTSRPPISLRSETRIVSSSPSASSLSSRRMFAVLPESSGLRIRLSLSPASLTSIHQPRVSRLRRAVVCEAQETTTDIQVVNDSTWDSLVLKATGPVVVDFWAPWCGPCKMIDPLVNDLAQHYTGKIKFYKLNTDESPNTPGQYGVRSIPTIMIFVGGEKKDTIIGAVPKTTLTSSLDKFLP

SEQ ID NO: 50159 - protein, 93 aa, Arabidopsis thaliana; identical to SEQ ID NO: 9722
  misc_feature: Useful for making plants with modulated time to senescence

SEQ ID NO: 50160 - protein, 145 aa, Arabidopsis thaliana; identical to SEQ ID NO: 9491
  misc_feature: Useful for biocontainment applications
  misc_feature: Useful for making plants with modulated flowering time

SEQ ID NO: 50161 - protein, 137 aa, Arabidopsis thaliana
  misc_feature: Useful for making plants with modulated drought sensitivity
  misc_feature: Useful for making plants with modulated water use efficiency
MADSTKAGLKKPAFTKVDQLRPGTSGHNVNVKIVSTKMVLQKGRADGPQARQLRISECIVGDETGVIVFTARNDQVDLMKEGSTVTLRNAKIDMYKGSMRLAVDKWGRVEVTEPASFKVKEDTNMSLIEYELVNVVE

SEQ ID NO: 50162 - protein, 223 aa, Zea mays; identical to SEQ ID NO: 9470
  misc_feature: Useful for making plants with altered lignin content

SEQ ID NO: 50163 - protein, 226 aa, Glycine max
  misc_feature: Useful for making plants with altered alkaloid content
MAFYNEEEKTEDYLFKIVLIGDSAVGKSNLLARFARDEFYPNSKSTIGVEFQTQKMDINGKEVKAQIWDTAGQERFRAVTSAYYRGAVGALLVYDISRHQTFDSIGRWLNELHTHSDMNVVTILVGNKSDLKDAREVATAEGKALAEAQGLFFMETSALDSSNVAAAFETVVKEIYNILSRKVMMSQELNKQDVTRIENGKTVVLQGEGEGDGEADAQSKKRCCSS

SEQ ID NO: 50164 - protein, 214 aa, Arabidopsis thaliana; identical to SEQ ID NO: 9553
  misc_feature: Useful for making plants with altered terpenoid content

SEQ ID NO: 50165 - protein, 206 aa, Arabidopsis thaliana [sequence omitted]

SEQ ID NO: 50166 - protein, 206 aa, Arabidopsis thaliana; identical to SEQ ID NO: 9243
  misc_feature: Useful for making plants with modulated nitrogen use efficiency
  misc_feature: Useful for making plants with modulated phosphate use efficiency

SEQ ID NO: 50167 - protein, 94 aa, Zea mays
  misc_feature: Useful for making plants with modulated nitrogen use efficiency
MGSLGPTVSLSIMARPGGQQPAEMERKKDSGVFFGGGCGFRMPLHYPRYKKADYESMPEWRVDCLLREYGLPADGDVDSKRRFAMGAFLWPDQY

SEQ ID NO: 50168 - protein, 423 aa, Arabidopsis thaliana
  misc_feature: Useful for making plants with modulated root development
MARKKIREYDSKRLVKEHFKRLSGKELPIRSVQINETTDLNELVEKEPWLSSEKLVVKPDMLFGKRGKSGLVALKLDFADVATFVKERLGKEVEMSGCKGPITTFIVEPFVPHNEEYYLNVVSDRLGCSISFSECGGIEIEENWDKVKTIFLPTGASLTPEICAPLVATLPLEIKAEIEEFIKVIFTLFQDLDFTFLEMNPFTLVDGSPYPLDMRGELDDTAAFKNFKKWGDIEFPLPFGRVMSPTESFIHGLDEKTSASLKFTVLNPKGRIWTMVAGGGASVIYADTVGDLGYASELGNYAEYSGAPKEDEVLQYARVVIDCATANPDGKSRALVIGGGIANFTDVAATFNGIIRALKEKEAKLKAARMHIFVRRGGPNYQKGLAKMRALGDDIGVPIEVYGPEATMTGICKEAIQYITAAA

SEQ ID NO: 50169 - protein, 70 aa, Zea mays
  misc_feature: Useful for making plants with modulated nitrogen use efficiency
MAPTSKLSTGIKRASRSHTYHRRGLWAIKAKNGGAFPKADKAAAAVEPKFYPADDGGERQESVSPPSDGS

SEQ ID NO: 50170 - protein, 173 aa, Arabidopsis thaliana; identical to SEQ ID NO: 9255
  misc_feature: Useful for making plants with modulated flowering time

SEQ ID NO: 50171 - protein, 206 aa, Arabidopsis thaliana
  misc_feature: Useful for making plants with modulated nitrogen use efficiency
MPRSSRWVNQRATSKIKKFILFLGVAFVFYLYRYPSSPSTVEQSSTSIYNISVKDIEGKDVSLSKFTGKVLLIVNVASKCGLTHGNYKEMNILYAKYKTQGFEILAFPCNQFGSQEPGSNMEIKETVCNIFKAEFPIFDKIEVNGKNTCPLYNFLKEQKGGLFGDAIKWNFAKFLVDRQGNVVDRYAPTTSPLEIEKDIVKLLASA

SEQ ID NO: 50172 - protein, 161 aa, Arabidopsis thaliana
  misc_feature: Useful for making plants with modulated biomass
  misc_feature: Useful for making plants with modulated flowering time
MASKNSASLALFFALNILFFTLTVATNCNCKPSPKPKPVPSPKPKPVQCPPPPRPSVPSPNPRPVTPPRTPGSSGNSCPIDALKLGVCANVLSSLLNIQLGQPSSQQCCSLIQGLVDVDAAICLCTALRANVLGINLNVPISLSVLLNVCNRKLPSGFQCA

SEQ ID NO: 50173 - protein, 187 aa, Zea mays subsp. mays; identical to SEQ ID NO: 9458
  misc_feature: Useful for making plants with modulated nitrogen use efficiency

SEQ ID NO: 50174 - protein, 252 aa, Arabidopsis thaliana; identical to SEQ ID NO: 9570
  misc_feature: Useful for making plants with altered alkaloid content

SEQ ID NO: 50175 - protein, 246 aa, Arabidopsis thaliana; identical to SEQ ID NO: 9331
  misc_feature: Useful for making plants with altered lignin content
  misc_feature: Useful for making plants with modulated flowering time

SEQ ID NO: 50176 - protein, 1145 aa, Arabidopsis thaliana
  misc_feature: Useful for making plants with altered cell wall content and/or composition
MASNNHFMNSRSNLSTNSDAAEAERHQQPVSNSVTFARRTPSGRYVNYSRDDLDSELGSVDLTGYSVHIPPTPDNQPMDPSISQKVEEQYVSNSLFTGGFNSVTRAHLMEKVIDTETSHPQMAGAKGSSCAVPGCDVKVMSDERGQDLLPCECDFKICRDCFMDAVKTGGMCPGCKEPYRNTDLADFADNNKQQRPMLPPPAGGSKMDRRLSLMKSTKSGLMRSQTGDFDHNRWLFETSGTYGFGNAFWTKDGNFGSDKDGNGHGMGPQDLMSRPWRPLTRKLQIPAAVISPYRLLILIRIVVLALFLMWRIKHKNPDAIWLWGMSVVCELWFALSWLLDQLPKLCPINRATDLNVLKEKFETPTPSNPTGKSDLPGLDMFVSTADPEKEPPLVTSNTILSILAADYPVEKLACYVSDDGGALLTFEAMAEAASFANMWVPFCRKHNIEPRNPDSYFSLKRDPYKNKVKADFVKDRRRVKREYDEFKVRINSLPDSIRRRSDAYHAREEIKAMKLQRQNRDEEIVEPVKIPKATWMADGTHWPGTWINSGPDHSRSDHAGIIQVMLKPPSDEPLHGVSEGFLDLTDVDIRLPLLVYVSREKRPGYDHNKKAGAMNALVRASAIMSNGPFILNLDCDHYIYNSQALREGMCFMMDRGGDRLCYVQFPQRFEGIDPSDRYANHNTVFFDVNMRALDGLMGPVYVGTGCLFRRIALYGFDPPRAKEHHPGFCSCCFSRKKKKSRVPEENRSLRMGGDSDDDEEMNLSLVPKKFGNSTFLIDSIPVAEFQGRPLADHPAVQNGRPPGALTIPRELLDASTVAEAIAVISCWYEDKTEWGSRIGWIYGSVTEDVVTGYRMHNRGWKSVYCVTKRDAFRGTAPINLTDRLHQVLRWATGSVEIFFSRNNAFFASPRMKILQRIAYLNVGIYPFTSFFLIVYCFLPALSLFSGQFIVQTLNVTFLVYLLIISITLCLLALLEIKWSGISLEEWWRNEQFWLIGGTSAHLAAVIQGLLKVVAGIEISFTLTSKSGGEDVDDEFADLYIVKWTSLMIPPITIMMVNLIAIAVGFSRTIYSVIPQWSKLIGGVFFSFWVLAHLYPFAKGLMGRRGRTPTIVYVWSGLVAITISLLWVAINPPAGSTQIGGSFTFP

SEQ ID NO: 50177 - protein, 1065 aa, Arabidopsis thaliana
  misc_feature: Useful for making plants with altered cell wall content and/or composition
  misc_feature: Useful for making plants with modulated biomass
MVAGSYRRYEFVRNRDDSDDGLKPLKDLNGQICQICGDDVGLTKTGNVFVACNECGFPLCQSCYEYERKDGSQCCPQCKARFRRHNGSPRVEVDEKEDDVNDIENEFDYTQGNNKARLPHRAEEFSSSSRHEESLPVSLLTHGHPVSGEIPTPDRNATLSPCIDPQLPGIYQLLLLPVRILDPSKDLNSYGLVNVDWKKRIQGWKLKQDKNMIHMTGKYHEGKGGEFEGTGSNGDELQMVDDARLPMSRVVHFPSARMTPYRIVIVLRLIILGVFLHYRTTHPVKDAYALWLTSVICEIWFAFSWLLDQFPKWYPINRETFLDRLALRYDRDGEPSQLAPVDVFVSTVDPMKEPPLVTANTVLSILAVDYPVDKVACYVSDDGSAMLTFEALSETAEFSKKWVPFCKKFNIEPRAPEFYFSQKIDYLKDKIQPSFVKERRAMKREYEEFKVRINILVAKAQKIPEDGWTMEDGTSWPGNNPRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNTVFFDINLKGLDGIQGPVYVGTGCCFNRQALYGYDPVLTEEDLEPNIIVKSCFGSRKKGKSRKIPNYEDNRSIKRSDSNVPLFNMEDIDEDVEGYEDEMSLLVSQKRLEKRFGQSPVFIAATFMEQGGLPSTTNPLTLLKEAIHVISCGYEAKTDWGKEIGWIYGSVTEDILTGFKMHARGWISIYCVPSRPAFKGSAPINLSDRLNQVLRWALGSIEILLSRHCPIWYGYNGRLKLLERIAYINTIVYPITSIPLLAYCMLPAFCLITNTFIIPEISNLASLCFMLLFASIYASAILELKWSDVALEDWWRNEQFWVIGGTSAHLFAVFQGLLKVFAGIDTNFTVTSKASDEDGDFAELYVFKWTSLLIPPTTILLVNLVGIVAGVSYAINSGYQSWGPLMGKLLFAFWVVAHLYPFLKGLLGRQNRTPTIVIVWSALLASIFSLLWVRINPFVSTTGVMSNSFMGE

SEQ ID NO: 50178 - protein, 147 aa, Arabidopsis thaliana
  misc_feature: Useful for making plants with modulated nitrogen use efficiency
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGGHGGGGHYGGGGGGYGGGGGHHGGGGHGLNEPVQTKPGV

SEQ ID NO: 50179 - protein, 108 aa, Arabidopsis thaliana
  misc_feature: Useful for making plants with modulated nitrogen use efficiency
  misc_feature: Useful for making plants with modulated phosphate use efficiency
MASKALILLGLFAILLVVSEVSAARQSGMVKPESEETVQPEGYHGGHGGHGGGGHYGGGGHGHGGHNGGGGHGLDGYGGGHGGHYGGGGHHGGGGHGLNEPVQTKPGV

SEQ ID NO: 50180 - protein, 169 aa, Arabidopsis thaliana; identical to SEQ ID NO: 9703
  misc_feature: Useful for making plants with altered alkaloid content

SEQ ID NO: 50181 - protein, 137 aa, Arabidopsis thaliana
  misc_feature: Useful for biocontainment applications
MEDVKGKEIIDDAPIDNKVSDEMESEENAIKKKYGGLLPKKIPLISKDHERAFFDSADWALGKQKGQKPKGPLEALRPKLQPTPQQQPRARRMAYSSGETEDTEIDNNEAPDDQACASAVDSTNLKDDGGAKDNIKS

SEQ ID NO: 50182 - protein, 150 aa, Arabidopsis thaliana; identical to SEQ ID NO: 9668
  misc_feature: Useful for making plants with modulated biomass

SEQ ID NO: 50183 - protein, 136 aa, Arabidopsis thaliana
  misc_feature: Useful for making plants with altered alkaloid content
MAFCNKLSGILRQGVSHSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 50184 - protein, 130 aa, Arabidopsis thaliana; identical to SEQ ID NO: 9185
  misc_feature: Useful for making plants with altered lignin content
  misc_feature: Useful for making plants with modulated nitrogen use efficiency

SEQ ID NO: 50185 - protein, 141 aa, Arabidopsis thaliana; identical to SEQ ID NO: 9716
  misc_feature: Useful for making plants with modulated flowering time

SEQ ID NO: 50186 - protein, 40 aa, Arabidopsis thaliana; identical to SEQ ID NO: 9569
  misc_feature: Useful for making plants with modulated nitrogen use efficiency

SEQ ID NO: 50187 - protein, 107 aa, Arabidopsis thaliana
  misc_feature: Useful for making plants with modulated cold sensitivity
MADQNPRIIVEQNPSQARLDELKFKSWPKWGCSPGKYHLKYEAEEICYILRGKVKVYPKPPPSSSSDAEVEWCVEFGAGDIVTFPKGLSCTWDVSLSVDKHYIFLSS

SEQ ID NO: 50188 - protein, 122 aa, Panicum virgatum; identical to SEQ ID NO: 10297
  misc_feature: Useful for making plants with altered carbohydrate content

SEQ ID NO: 50189 - protein, 142 aa, Glycine max; identical to SEQ ID NO: 9583
  misc_feature: Useful for making plants with altered lignin content

SEQ ID NO: 50190 - protein, 142 aa, Arabidopsis thaliana; identical to SEQ ID NO: 9320
  misc_feature: Useful for making plants with modulated heat sensitivity

SEQ ID NO: 50191 - protein, 381 aa, Medicago sativa
  misc_feature: Useful for making plants with modulated salt sensitivity
MANYALANVFILLLNLSTLLIVLACPYCPYPSPKPPTHHPPIVKPPVHKRRKYSPTPKPPVHKPPRYPPKPSPCPPPSSTPKPPHVPKPPHHPKPPVVHPPHVPKPPVHPPYVPKPPIVKPPIVHPPYVPKPPVVKPPPYVPKPPVVRPPYVPKPPVVPVTPPYVPKPPVVRPPYVPKPPVVPVTPPYVPKPPIVKPPIVFPPHVPLPPVVPSPPPYVPSPPIVKPPIVFPPHVPLPPVVPVTPPYVQPPPIVTPPTPTPPIVTPPVVSPPTPPSETPCPPPPLVPYPPTPPAQQTCSIDALKLGACVDVLGGLIHIGIGGSAKQTCCPLLQGLVDLDAAICLCTTIRLKLLNINLVIPLALQVLIDCGKTPPEGFKCPAY

SEQ ID NO: 50192 - protein, 190 aa, Arabidopsis thaliana
  misc_feature: Useful for making plants with modulated biomass
MFSAQNKINKDKNAEPTECEEQVAQALFDLENTNQELKSELKDLYINQAVHMDISGNRKAVVIYVPFRLRKAFRKIHPRLVRELEKKFSGKDVIFVTTRRIMRPPKKGAAVQRPRNRTLTSVHEAMLEDVAFPAEIVGKRTRYRLDGSKIMKVFLDAKEKNNTEYKLETMVGVYRKLTGKDVVFEYPVEA

SEQ ID NO: 50193 - protein, 207 aa, Pennisetum glaucum
  misc_feature: Useful for making plants with modulated water use efficiency
MATRRRMLLKVIILGDSGVGKTSLMNQYVNKKFSNQYKATIGADFLTKEVQIDDRLFTLQIWDTAGQERFQSLGVAFYRGADCCVLVYDVNVTKSFEKLNNWREEFLLQASPSDPENFPFVLLGNKIDVDGGNSRTISEKKAKAWCASKGNIPYFETSAKEGFNVEAAFECIARNAIKNEPEDDMYLPDTIDVGGAGRQQRSSGCEC

SEQ ID NO: 50194 - protein, 135 aa, Arabidopsis thaliana
  misc_feature: Useful for making plants with altered cell wall content and/or composition
MGSKIVQVFLMLALFATSALAQAPAPTPTATPPPATPPPVATPPPVATPPPAATPAPATPPPAATPAPATTPPSVAPSPADVPTASPPAPEGPTVSPSSAPGPSDASPAPSAAFSNKAFFAGTAFAAIMYAAVLA

SEQ ID NO: 50195 - protein, 286 aa, Vicia faba
  misc_feature: Useful for making plants with modulated water use efficiency
MEGKEEDVRVGANKFPERQPIGTSAQSDKDYKEPPPAPFFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAHGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVVVIRAIPFKSRS

SEQ ID NO: 50196 - protein, 285 aa, Arabidopsis thaliana; identical to SEQ ID NO: 9410
  misc_feature: Useful for making plants with modulated drought sensitivity

SEQ ID NO: 50197 - protein, 291 aa, Arabidopsis thaliana; identical to SEQ ID NO: 9486
  misc_feature: Useful for making plants with modulated cold sensitivity

SEQ ID NO: 50198 - protein, 441 aa, Arabidopsis thaliana; identical to SEQ ID NO: 9513
  misc_feature: Useful for making plants with altered terpenoid content

SEQ ID NO: 50199 - protein, 258 aa, Arabidopsis thaliana
  misc_feature: Useful for biocontainment applications
  misc_feature: Useful for making plants with modulated biomass
MSISMALFSPPISSSLQNPNLIPKISTSLLSTKRFSLISVPRASSDNGTTSPVVKIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSTVSSKK

SEQ ID NO: 50200 - protein, 260 aa, Arabidopsis thaliana
  misc_feature: Useful for making plants with altered cell wall content and/or composition
MEGGSITPGEDKPEIQSPIPPNQIFILSGQSNMAGRGGVFKDHHNNRWVWDKILPPECAPNSSILRLSADLRWEEAHEPLHVDIDTGKVCGVGPGMAFANAVKNRLETDSAVIGLVPCASGGTAIKEWERGSHLYERMVKRTEESRKCGGEIKAVLWYQGESDVLDIHDAESYGNNMDRLIKNLRHDLNLPSLPIIQVAIASGGGYIDKVREAQLGLKLSNVVCVDAKGLPLKSDNLHLTTEAQVQLGLSLAQAYLSNFC

SEQ ID NO: 50201 - protein, 348 aa, Arabidopsis thaliana; identical to SEQ ID NO: 9478
  misc_feature: Useful for making plants with modulated nitrogen use efficiency

SEQ ID NO: 50202 - protein, 78 aa, Arabidopsis thaliana; identical to SEQ ID NO: 9685
  misc_feature: Useful for making plants with modulated cold sensitivity
  misc_feature: Useful for making plants with modulated salt sensitivity

SEQ ID NO: 50203 - protein, 286 aa, Arabidopsis thaliana; identical to SEQ ID NO: 9565
  misc_feature: Useful for making plants with altered cell wall content and/or composition
  misc_feature: Useful for making plants with modulated biomass

SEQ ID NO: 50204 - protein, 219 aa, Arabidopsis thaliana
  misc_feature: Useful for making plants with modulated nitrogen use efficiency
MATSMIPIFVTFMLVAAHMALADTNMLQDFCVADLSNGLKVNGYPCKDPAKVTPEDFYFIGLATAAATANSSMGSAVTGANVEKVPGLNTLGVSISRIDYAPGGLNPPHLHPRASEAIFVLEGRLFVGFLTTTGKLISKHVNKGDVFVFPKALLHFQQNPNKAPASVLAAFDSQLPGTQVVGPSLFGSNPPIPDDLLAKAFGAAAPEIQKIKGKFPPKK

SEQ ID NO: 50205 - protein, 191 aa, Arabidopsis thaliana
  misc_feature: Useful for making plants with altered cell wall content and/or composition
MARSFAIAVICIVLIAGVTGQAPTSPPTATPAPPTPTTPPPAATPPPVSAPPPVTTSPPPVTTAPPPANPPPPVSSPPPASPPPATPPPVASPPPPVASPPPATPPPVATPPPAPLASPPAQVPAPAPTTKPDSPSPSPSSSPPLPSSDAPGPSTDSISPAPSPTDVNDQNGASKMVSSLVFGSVLVWFMI

SEQ ID NO: 50206 - protein, 131 aa, Panicum virgatum; identical to SEQ ID NO: 1264
  misc_feature: Useful for making plants with altered carbohydrate content

SEQ ID NO: 50207 - protein, 306 aa, Oryza sativa
  misc_feature: Useful for making plants with modulated light quality sensitivity
MSSIAPSMRTRVRIPGYLSFMYHMFCCSHVVNSCFFSSIFFPDGVAMEEKEDSLRASVTEQDTEALLLRDVLINGILAIGTLGHNVNSLCPESCIEQDEPIIMCDEKVEQEKCEEEKAEAKQDTPVTAPSEPASALEPAKMHSSSMKEDNFMCFVKEEILMHGMEVEDVPNIQERPLLMLEKVEKVRTTLADLFAAEAFSSSDAEDKCYPKIVIVAGASTSKPTSCMEKMHHKKPTKPTSKPLKATRKLSRVWFSSSLLYLLSLVTLYFTSLEFITLCSMVSAPHLTHMFYHIATTGVSIMHLASL

SEQ ID NO: 50208 - protein, 261 aa, Panicum virgatum; identical to SEQ ID NO: 3568
  misc_feature: Useful for making plants with altered carbohydrate content

SEQ ID NO: 50209 - protein, 246 aa, Arabidopsis thaliana
  misc_feature: Useful for making plants with altered cell wall content and/or composition
MATSRTFIFSNLFIFFLVIATTYGQAPAPGPSGPTNITAILEKAGQFTLFIRLLKSTQASDQINTQLNSSSSNGLTVFAPTDNAFNSLKSGTLNSLSDQQKVQLVQFHVLPTLITMPQFQTVSNPLRTQAGDGQNGKFPLNITSSGNQVNITTGVVSATVANSVYSDKQLAVYQVDQVLLPLAMFGSSVAPAPAPEKGGSVSKGSASGGDDGGDSTDSSDAERTGFGFGIRITTVAAIAASSSLWI

SEQ ID NO: 50210 - protein, 128 aa, Arabidopsis thaliana; identical to SEQ ID NO: 9183
  misc_feature: Useful for making plants with altered lignin content
  misc_feature: Useful for making plants with modulated biomass
  misc_feature: Useful for making plants with modulated nitrogen use efficiency

SEQ ID NO: 50211 - protein, 304 aa, Brassica napus; identical to SEQ ID NO: 9208
  misc_feature: Useful for making plants with modulated biomass
  misc_feature: Useful for making plants with modulated flowering time

SEQ ID NO: 50212 - protein, 299 aa, Glycine max
  misc_feature: Useful for making plants with altered lignin content
  misc_feature: Useful for making plants with altered terpenoid content
  misc_feature: Useful for making plants with modulated flowering time
  misc_feature (239)..(239): Xaa is any aa, unknown, or other
MSSIHHYSPETTLYWTSDHQQQQQQQQQQQQQAATWLSNSHTPRFNLNEDDDEEDDVVVSDKATNNLAQEQEKEAMFEKPLTPSDVGKLNRLVIPKQHAEKYFPLDSSGGDSAAAKGLLLSFEDESGKCWRFRYSYWNSSQSYVLTKGWSRYVKDKRLHAGDVVLFHRHRAHPQRFFISCTRHQPNPNPPAHVSIRSSSYSALPAYPTHHHHHLPFPYQPHSLHAPGGGSQGQNETTPXGNSSSGRVLRLFGVNMECQPDNDNDSQNSTHECSYTHLYHHQTSSYPSSNPHHHMLPQQP

SEQ ID NO: 50213 - protein, 175 aa, Arabidopsis thaliana
  misc_feature: Useful for making plants with modulated biomass
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 50214 - protein, 170 aa, Arabidopsis thaliana
  misc_feature: Useful for biocontainment applications
  misc_feature: Useful for making plants with modulated biomass
  misc_feature: Useful for making plants with modulated flowering time
  misc_feature: Useful for making plants with modulated light quality response
MATQDSQGIKLFGKTIAFNTRTIKNEEETHPPEQEATIAVRSSSSSDLTAEKRPDKIIACPRCKSMETKFCYFNNYNVNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 50215 - protein, 315 aa, Arabidopsis thaliana; identical to SEQ ID NO: 9556
  misc_feature: Useful for making plants with modulated biomass

SEQ ID NO: 50216 - protein, 358 aa, Arabidopsis thaliana; identical to SEQ ID NO: 9254
  misc_feature: Useful for making plants with modulated phosphate use efficiency

SEQ ID NO: 50217 - protein, 391 aa, Arabidopsis thaliana
  misc_feature: Useful for making plants with modulated biomass
MASASFVKPNTLSSPWIGQRSFAHTSASSSPPPRVSFAIRAGAYSDELVKTAKSIASPGRGILAIDESNATCGKRLASIGLDNTEDNRQAYRQLLLTTPGLGDYISGSILFEETLYQSTKDGKTFVDCLRDANIVPGIKVDKGLSPLAGSNEESWCQGLDGLASRSAEYYKQGARFAKWRTVVSVPCGPSALAVKEAAWGLARYAAISQDNGLVPIVEPEILLDGDHPIERTLEVAEKVWSEVFFYLAQNNVMFEGILLKPSMVTPGAEHKNKASPETVADFTLTMLKRRVPPAVPGIMFLSGGQSEAEATLNLNAMNQSPNPWHVSFSYARALQNSVLRTWQGKPEKIEASQKALLVRAKANSLAQLGKYSAEGENEDAKKGMFVKGYTY

SEQ ID NO: 50218 - protein, 98 aa, Arabidopsis thaliana
  misc_feature: Useful for making plants with altered lignin content
  misc_feature: Useful for making plants with modulated drought sensitivity
MDEDDSDGEDSEEEEPTPKKPASSKKRANETTPKAPVSAKKAKVAVTPQKTDEKKKGGKAANQSPKSASQVSCGSCKKTFNSGNALESHNKAKHAAAK

SEQ ID NO: 50219 - protein, 182 aa, Arabidopsis thaliana; identical to SEQ ID NO: 9385
  misc_feature: Useful for making plants with modulated nitrogen use efficiency

SEQ ID NO: 50220 - protein, 94 aa, Zea mays
  misc_feature: Useful for making plants with altered terpenoid content
MGQAFRKLFDSFFGTSEMRVVMLGLDAAGKTTILYKLHIGEVLSTVPTIGFNVEKVQYKNVMFTVWDVGGQEKLRVTTSAKEMSLGISPLEGVQ

SEQ ID NO: 50221 - protein, 289 aa, Panicum virgatum; identical to SEQ ID NO: 412
  misc_feature: Useful for biocontainment applications

SEQ ID NO: 50222 - protein, 357 aa, Pinus sylvestris
  misc_feature: Useful for making plants with modulated water use efficiency
MSSVLTDLLNLDLSDVTEKVIAEYIWIGGSGMDMRSKARSLSGPVSSVKELPKWNYDGSSTGQAQGHDSEVILYPQAIFRDPFRRGKHILVICDAYSPNGTAIPSNKRAAAAKIFNEKAVSDEETWYGLEQEYTLLQKDVKWPLGWPIGGYPGPQGPYYCGVGADKAWGRDIVDAHYKACLYSGINISGINGEVMPGQWEFQVGPSVGISAADELWCARFIMERITEKAGVVLSFDPKPIEGDWNGAGCHTNYSTKSMRKEGGFEVIKKAIEKLKLRHKEHISAYGEGNERRLTGRHETADMNTFSWGVANRGASVRVGRDTEKEGKGYFEDRRPASNMDPYIVTSMIAETTILWKP

SEQ ID NO: 50223 - protein, 217 aa, Zea mays; identical to SEQ ID NO: 9381
  misc_feature: Useful for making plants with altered lignin content

SEQ ID NO: 50224 - protein, 171 aa, Glycine max
  misc_feature: Useful for making plants with altered lignin content
  misc_feature (69)..(69): Xaa is any aa, unknown, or other
  misc_feature (84)..(84): Xaa is any aa, unknown, or other
  misc_feature (125)..(125): Xaa is any aa, unknown, or other
  misc_feature (150)..(150): Xaa is any aa, unknown, or other
  misc_feature (151)..(151): Xaa is any aa, unknown, or other
  misc_feature (154)..(154): Xaa is any aa, unknown, or other
  misc_feature (157)..(157): Xaa is any aa, unknown, or other
  misc_feature (162)..(162): Xaa is any aa, unknown, or other
MEGGRSSASNGNCEVRYRGIRRRPWGKFAAEIRDPTRKGTRIWLGTFDTAEQAARAYDAAAFHFRGHRXILNFPNEYQSHNPNXSLPMPLIVPPPSYSSSFTSNYSGDDNNHLVRPGEIMQGGDXDDTFELEYLDNKLLEELLQMQDNRXXYKXNIXQANQXGSTAMYGMK

SEQ ID NO: 50225 - protein, 138 aa, Glycine max
  misc_feature: Useful for making plants with altered lutein content
  misc_feature: Useful for making plants with modulated biomass
  misc_feature: Useful for making plants with modulated flowering time
  misc_feature (72)..(72): Xaa is any aa, unknown, or other
  misc_feature (95)..(95): Xaa is any aa, unknown, or other
MEEESKEKKKDTKEEPRYRGVRRRPWGKFAAEIRDPARHGARVWLGTFLTAEEAARAYDRAAYEMRGALAVXNFPNEYPSCSSMNSSSTLAPSSXSSNSMLKSDHGKQVIEFECLDDKLLEDLLDCDDYAYEKDLPKN

SEQ ID NO: 50226 - protein, 211 aa, Glycine max
  misc_feature: Useful for making plants with altered alkaloid content
  misc_feature: Useful for making plants with altered lignin content
MSSTTTDSDCSYLEQIQQYLLHNDSTILTPPQAFPSPSHDSSSDASVHFEHPSEAHDVNAPPKWRRYRGVRRRPWGKFAAEIRDPKKNGSRVWLGTYVNEEEAALAYDKAAFNMRGQKAKLNFPHLIGSAVQPEPPCLAVSKRSLPESSPPTSPYDSCESKGSKRRKSLVDLLNNLAKNKSQAKVVEMALEANEVEQWVNELNDCTLFWCS

SEQ ID NO: 50227 - protein, 131 aa, Oryza sativa
  misc_feature: Useful for biocontainment applications
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 50228 - protein, 312 aa, Panicum virgatum; identical to SEQ ID NO: 886
  misc_feature: Useful for making plants with altered carbohydrate content

SEQ ID NO: 50229 - protein, 324 aa, Arabidopsis thaliana
  misc_feature: Useful for making plants with altered cell wall content and/or composition
MASNKLISILVLVVTLLLQGDNNYVVEAQLTTNFYSTSCPNLLSTVQTAVKSAVNSEARMGASILRLFFHDCFVNGCDGSILLDDTSSFTGEQNAAPNRNSARGFNVIDNIKSAVEKACPGVVSCADILAIAARDSVVALGGPNWNVKVGRRDARTASQAAANSNIPAPTSSLSQLISSFSAVGLSTRDMVALSGAHTIGQSRCTNFRARIYNETNINAAFATTRQRTCPRASGSGDGNLAPLDVTTAASFDNNYFKNLMTQRGLLHSDQVLFNGGSTDSIVRGYSNNPSSFNSDFTAAMIKMGDISPLTGSSGEIRKVCGRTN

SEQ ID NO: 50230 - protein, 321 aa, Arabidopsis thaliana; identical to SEQ ID NO: 9530
  misc_feature: Useful for making plants with modulated nitrogen use efficiency

SEQ ID NO: 50231 - protein, 307 aa, Arabidopsis thaliana
  misc_feature: Useful for making plants with altered cell wall content and/or composition
MRSRDMERGRKHRGDTQWTAWLTPTIVVANVSIFIVVMYTNDCPKTTTGANGDCVAKLLRRFSFQPLRENPFLGPSSSTLEKLGALDWKKVVQGNEKWRLITAMWLHAGIIHLVMNMFDVIIFGIRLEQQFGFIRIGLIYLISGFGGSILSALFLQKSISVGASGALLGLMGAMLSELLTNWTIYKSKLCALLSFLFIIAINLAIGLLPWVDNFAHIGGLLTGFCLGFILLMQPQSGWEEFRNSSQYGARARSKYNPCQYVLFFVAAVLVVAGLTVGLVMLFDGENGNKHCKWCHRLDCYPTSKWSC

SEQ ID NO: 50232 - protein, 282 aa, Arabidopsis thaliana
  misc_feature: Useful for making plants with altered alkaloid content
  misc_feature: Useful for making plants with altered lignin content
  misc_feature: Useful for making plants with modulated nitrogen use efficiency
  misc_feature (234)..(234): Xaa is any aa, unknown, or other
  misc_feature (242)..(242): Xaa is any aa, unknown, or other
MGRSPCCEKAHINKGAWTKEEDERLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINXMECRCGRXRCDVVGGSSKGSDMSNGFDFLGLAKKETTSLLGFRSLEMK

SEQ ID NO: 50233 - protein, 274 aa, Panicum virgatum; identical to SEQ ID NO: 5352
  misc_feature: Useful for making plants with altered carbohydrate content

SEQ ID NO: 50234 - protein, 282 aa, Arabidopsis thaliana
  misc_feature: Useful for making plants with altered cell wall content and/or composition
MGRQPCCDKVGLKKGPWTAEEDRKLINFILTNGQCCWRAVPKLSGLLRCGKSCRLRWTNYLRPDLKRGLLSDYEEKMVIDLHSQLGNRWSKIASHLPGRTDNEIKNHWNTHIKKKLRKMGIDPLTHKPLSIVEKEDEEPLKKLQNNTVPFQETMERPLENNIKNISRLEESLGDDQFMEINLEYGVEDVPLIETESLDLICSNSTMSSSTSTSSHSSNDSSFLKDLQFPEFEWSDYGNSNNDNNNGVDNIIENNMMSLWEISDFSSLDLLLNDESSSTFGLF

SEQ ID NO: 50235 - protein, 336 aa, Arabidopsis thaliana
  misc_feature: Useful for biocontainment applications
MGRHSCCYKQKLRKGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 50236 - protein, 359 aa, Oryza sativa
  misc_feature: Useful for making plants with modulated biomass
MGHHSCCNQQKVKRGLWSPEEDEKLIRYITTHGYGCWSEVPEKAGLQRCGKSCRLRWINYLRPDIRRGRFTAEEEKLIISLHAIVGNRWAHIASHLPGRTDNEIKNYWNSWIKKKIRKPAAAAAAATTTSPNNPPPCSTATSDHHHLPPPAFGGADHHLQLDAIINQNLISSLPPKLATGDDSPPAVPGLPHHCPLFMFDTTTTGAGGAISPPPPSSLIPTHLHHHHHPFIASFTAAMAADTPSYLPPLVDGMAAMGAAMDCSLEDGQTAAAMAATNGYYQHHQKHQQLEIELEEEEQRQLGHHHHQHHHEHEHENHQWDEEEAQHLLMWDQEVLTSSNLEAMQSGAHSLLFMGPNDHD

SEQ ID NO: 50237 - protein, 333 aa, Arabidopsis thaliana
  misc_feature: Useful for making plants with modulated low light sensitivity
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 50238 - protein, 310 aa, Arabidopsis thaliana
  misc_feature: Useful for making plants with altered terpenoid content
  misc_feature: Useful for making plants with modulated biomass
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFMNQTNSFCDQEDVKPVLIKNMVKIEDQELEKTNPHHHQDSMTNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 50239 - protein, 283 aa, Arabidopsis thaliana
  misc_feature: Useful for making plants with modulated biomass
  misc_feature: Useful for making plants with modulated flowering time
MSNITKKKCNGNEEGAEQRKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFN

SEQ ID NO: 50240 - protein, 333 aa, Craterostigma plantagineum; identical to SEQ ID NO: 9317
  misc_feature: Useful for making plants with modulated drought sensitivity

SEQ ID NO: 50241 - protein, 248 aa, Arabidopsis thaliana
  misc_feature: Useful for making plants with enhanced nutritional value
  misc_feature: Useful for making plants with modulated heat sensitivity
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLEESQEVDILVPEATTTEKGDTLAFDVDQLWSLFDGETVKFD

SEQ ID NO: 50242 - protein, 266 aa, Panicum virgatum; identical to SEQ ID NO: 10694
  misc_feature: Useful for making plants with altered carbohydrate content

SEQ ID NO: 50243 - protein, 286 aa, Arabidopsis thaliana; identical to SEQ ID NO: 9222
  misc_feature: Useful for making plants with altered lignin content
  misc_feature: Useful for making plants with altered terpenoid content

SEQ ID NO: 50244 - protein, 344 aa, Zea mays
  misc_feature: Useful for making plants with altered alkaloid content
  misc_feature: Useful for making plants with altered lignin content
MFPSSKKQASTGAANPNDRPMCGQGGDSGGLVLTTDPKPRLRWTPELHDRFVDAVAQLGGPDKATPKTIMRVMGVKGLTLYHLKSHLQKFRLGKQHKELGDHTAMEMQRSVASSSGMIARSMNDRSVNVNEALRIQMEVQRRLHGELEVQKHLQMRVEAQGKYMQSIVEKAYQALGSSDCATWPAGYRTLGSQGVLDIGTSSTSFSSVQDLQCFYGGSSHMDQLLHQMERPMDGFLTLGESCFIGSADNKKDPNNHCSSSGKSSMMWASEEQQAKSGNDQLQMGSSTRMEGAGIDVMDPVVTGLYEGAVSGDSMDSKGFEGSNSRLEMKPPAQQAPVGSQRIRI

SEQ ID NO: 50245 - protein, 334 aa, Panicum virgatum
  misc_feature: Useful for making plants with altered carbohydrate content
MAAGVLCFRAFALSMACLLLAVPLLVAQDPSKLSLEYYSKTCPNVEHVVRTEMECAMRADTRNAALMLRLHFHDCFVQGCDGSVLLDDTATMIGEKQADQNVNSLKGFELVDKIKEKLEAECPGTVSCADLLAIAARDAVVLVGGPYWDVPVGRLDSKKASLDLANSDIPTAQQGLLTLIAKFWQKGLDATDMVALVGSHTIGFARCENFRDRIYGDFEMTSKFNPSSEAYLSKLKEVCPRDSGDDNISAMDSHTSAIFDNAYYETLIKGEGLLNSDQEMWSSIAGYSTADTVNKYWADPAAFFKQFSDSMVKMGNITNPAGGEVRKNCRFVNT

SEQ ID NO: 50246 - protein, 336 aa, Arabidopsis thaliana
  misc_feature: Useful for making plants with altered cell wall content and/or composition
MMRLLFVFFMVHTIFIPCFSFDTPGKDLPLTLDYYKSTCPTVFDVIKKEMECIVKEDPRNAAIIIRLHFHDCFVQGCDGSVLLDETETLQGEKKASPNINSLKGYKIVDRIKNIIESECPGVVSCADLLTIGARDATILVGGPYWDVPVGRKDSKTASYELATTNLPTPEEGLISIIAKFYSQGLSVEDMVALIGAHTIGKAQCRNFRSRIYGDFQVTSALNPVSETYLASLREICPASSGEGDSNVTAIDNVTPNLFDNSIYHTLLRGEGLLNSDQEMYTSLFGIQTRRIVSKYAEDPVAFFEQFSKSMVKMGNILNSESLADGEVRRNCRFVNT

SEQ ID NO: 50247 - protein, 192 aa, Panicum virgatum; identical to SEQ ID NO: 10720
  misc_feature: Useful for making plants with altered carbohydrate content

SEQ ID NO: 50248 - protein, 210 aa, Glycine max; identical to SEQ ID NO: 9191
  misc_feature: Useful for making plants with modulated cold sensitivity

SEQ ID NO: 50249 - protein, 110 aa, Glycine max
  misc_feature: Useful for making plants with altered lignin content
MRRGRATAAVVDPTAEQAKETRFRGVRKRPWGRFAAEIRDPWKKQRVWLGTFDSAEDAARAYDKAARSFRGPKAKTNFPSFPGPTDHHSSQQIPPLYRPTGFPPSSSPPR

SEQ ID NO: 50250 - protein, 222 aa, Arabidopsis thaliana; identical to SEQ ID NO: 9387
  misc_feature: Useful for making plants with altered alkaloid content

SEQ ID NO: 50251 - protein, 240 aa, Glycine max; identical to SEQ ID NO: 9262
  misc_feature: Useful for making plants with altered oil content

SEQ ID NO: 50252 - protein, 404 aa, Arabidopsis thaliana
  misc_feature: Useful for making plants with modulated phosphate use efficiency
MDRTQSPKTALFAVLATLLVLTVNGQSLCKTHRFTNNLAFADCSDLSALGSFLHWTYNEQNGTVSIAYRHPGTSASSWVAWGLNPSSTQMVGTQALVAFTNTTTNQFQAYTSSVSSYGTRLERSSLSFGVSGLSATLVSGEVTIFATLELSPNLITANQLWQVGPVVNGVPASHQTSGDNMRSSGRIDFRTGQASAGGGGSGDRLRKRNTHGVLNAVSWGVLMPMGAMMARYMKVFADPTWFYLHIAFQVSGYVIGVAGWATGIKLGNDSPGTSYSTHRNLGIALFTFATLQVFALLVRPKPDHKYRTYWNVYHHTVGYTTIILSIVNIFKGFDILDPEDKWRWAYIGILIFLGACVLILEPLTWFIVLRRKSRGGNTVAAPTSSKYSNGVNGTTTTGPHHQDA

SEQ ID NO: 50253 - protein, 235 aa, Arabidopsis thaliana; identical to SEQ ID NO: 9318
  misc_feature: Useful for making plants with modulated flowering time

SEQ ID NO: 50254 - protein, 263 aa, Arabidopsis thaliana; identical to SEQ ID NO: 9494
  misc_feature: Useful for making plants with altered lignin content
  misc_feature: Useful for making plants with modulated nitrogen use efficiency

SEQ ID NO: 50255 - protein, 510 aa, Panicum virgatum; identical to SEQ ID NO: 4688
  misc_feature: Useful for making plants with altered carbohydrate content

SEQ ID NO: 50256 - protein, 508 aa, Arabidopsis thaliana
  misc_feature: Useful for making plants with altered cell wall content and/or composition
MKLYSLLSVFLVILLATSDSDAFTRNNFPKDFLFGAATSAYQWEGAVAEDGRTPSVWDTFSHTYNRGNLGNGDITSDGYHKYKEDVKLMAEMGLESFRFSISWSRLIPNGRGLINPKGLLFYKNLIKELISHGIEPHVTLYHYDLPQSLEDEYGGWINRKIIEDFTAYADVCFREFGEDVKLWTTINEATIFAIGSYDQGISPPGHCSPNKFINCTSGNSSTEPYLAGHNILLAHASASKLYKLKYKSTQKGSIGLSIFAFGLSPYTNSKDDEIATQRAKAFFYGWMLKPLVFGDYPDEMKRTVGSRLPVFSEEESEQLKGSSDFIGIIHYTTFYVTNKPSPSIFPSMNEGFFKDMGVYMISAANSSFLLWEATPWGLEGILEYIKQSYNNPPIYILENGMPMGRDSTLQDTQRIEFIQAYIGAMLNAIKNGSDTRGYFVWSMIDLYELLSGYTTSFGMYYVNFSDPGRKRTPKLSASWYTGFLNGTIDVATQDTIQLQSNISGSSSL

SEQ ID NO: 50257 - protein, 477 aa, Arabidopsis thaliana
  misc_feature: Useful for making plants with altered cell wall content and/or composition
MEKTFALITIFLAFAFSGKCSDVFSRCDFPEGFVFGSSTSAYQWEGAVAEDGRKPSVWDRFCHSHNNQGNGDITCDGYHKYKEDVKLMVDTNLDAFRFSISWSRLIPNRRGPVNQKGLQFYKNLIQELVNHGIEPYVTLHHFDHPQYLEDEYEGWLNHMIVEDFTAYADVCFREFGNHVKFWTTINEGNIFSIGGYNDGDSPPGRCSIPGQNCLLGNSSTEPYIVGHNLLLAHASVSRLYKQNYKDKQGGSIGFSILTIGFSPSTSSKDDAIATQRANDFFNGWMLGPLIYGDYPDTMKRIVGSRMPVFSEEESEQVKGSSDYIGINHYLAASITNSKLKPSISGNPDFYSDMNQSYGNPPVYVLENGRPINRDSQLKEKDTPRIEFLQAYIGGVLKSIRNGSDTRGYFVWSLMDLYEIKGGYDVGYGLYSVNFSDPHRKRSPKLSAHWYSDFLKGKTAFLGSQGITELQSNLSPYS

SEQ ID NO: 50258 - protein, 444 aa, Arabidopsis thaliana; identical to SEQ ID NO: 9198
  misc_feature: Useful for making plants with modulated flowering time

SEQ ID NO: 50259 - protein, 105 aa, Brassica napus
  misc_feature: Useful for making plants with modulated cold sensitivity
  misc_feature: Useful for making plants with modulated salt sensitivity
MEETTTFQGLRHLFMTVFLHGFSAFIVVPVITDVSMAALCPGKDECSLAIYLSGFQQAITGVGSLMMMPLVGSLSDKHGRKSLLTLPMALNILPLVFDVDVECSL

SEQ ID NO: 50260 - protein, 1084 aa, Arabidopsis thaliana
  misc_feature: Useful for making plants with modulated biomass
MNTGGRLIAGSHNRNEFVLINADESARIRSVQELSGQTCQICGDEIELTVSSELFVACNECAFPVCRPCYEYERREGNQACPQCKTRYKRIKGSPRVDGDDEEEEDIDDLEYEFDHGMDPEHAAEAALSSRLNTGRGGLDSAPPGSQIPLLTYCDEDADMYSDRHALIVPPSTGYGNRVYPAPFTDSSAPPQARSMVPQKDIAEYGYGSVAWKDRMEVWKRRQGEKLQVIKHEGGNNGRGSNDDDELDDPDMPMMDEGRQPLSRKLPIRSSRINPYRMLILCRLAILGLFFHYRILHPVNDAYGLWLTSVICEIWFAVSWILDQFPKWYPIERETYLDRLSLRYEKEGKPSGLAPVDVFVSTVDPLKEPPLITANTVLSILAVDYPVDKVACYVSDDGAAMLTFEALSDTAEFARKWVPFCKKFNIEPRAPEWYFSQKMDYLKNKVHPAFVRERRAMKRDYEEFKVKINALVATAQKVPEEGWTMQDGTPWPGNNVRDHPGMIQVFLGHSGVRDTDGNELPRLVYVSREKRPGFDHHKKAGAMNSLIRVSAVLSNAPYLLNVDCDHYINNSKAIRESMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGN

SEQ ID NO: 50261 - protein, 507 aa, Arabidopsis thaliana
  misc_feature: Useful for making plants with altered cell wall content and/or composition
MCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGN

SEQ ID NO: 50262 - protein, 469 aa, Panicum virgatum
  misc_feature: Useful for making plants with altered carbohydrate content
MLPLLLFLLAAAAASGPAAAQGLPPLPIGVNYGANADNLPSPAAVATFLATKTTVNRVKLFDANPAFLDAFAANAPAISIAVSIPNSALPAFADRAAGLDAARGWVRDNLAAHVAAGANVTLLLAGNEILGPTVVPDLVVSLLPAMRRLHQALQLEGLPQVRVTTPHYLGILAPSDGIPSNARFRPGLDAKVLAPMLRFHNDTGSPLMVNAYPYFSYNAQNLNYAVFRPNAGVYDPATKLNYTSMFDAQMDAIYTAMKKLGFGDVQIAVGEAGWPTQAEPGQVGVGPEEARDFNAGMIRVCSGGKGTPLMPGRTFETYIFSLFDENQKPGPIAERNFGIFNPDFTPKYDLGLLRDGSSASASPNPSPNPSPKPSPNPSPSGGGKWCVAKAGADATTLQNNINYACGFVDCKPIQSGGGCFDPNNVQSHASFVMNTYYQANGRHDSDCDFKGTGMVISKDPSYGGCKYVS

SEQ ID NO: 50263 - protein, 347 aa, Arabidopsis thaliana
  misc_feature: Useful for making plants with altered cell wall content and/or composition
MEKPESEKKSAVSDVGAWAMNVISSVGIIMANKQLMSSSGFGFGFATTLTGFHFAFTALVGMVSNATGLSASKHVPLWELLWFSIVANISIAAMNFSLMLNSVGFYQISKLSMIPVVCVLEWILHSKHYCKEVKASVMVVVIGVGICTVTDVKVNAKGFICACTAVFSTSLQQISIGSLQKKYSVGSFELLSKTAPIQAISLLICGPFVDYLLSGKFISTYQMTYGAIFCILLSCALAVFCNISQYLCIGRFSATSFQVLGHMKTVCVLTLGWLLFDSEMTFKNIAGMAIAIVGMVIYSWAVDIEKQRNAKSTPHGKHSMTEDEIKLLKEGVEHIDLKDVELGDTKP

SEQ ID NO: 50264 - protein, 770 aa, Arabidopsis thaliana
  misc_feature: Useful for making plants with modulated water use efficiency
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 50265 - protein, 374 aa, Zea mays
  misc_feature: Useful for making plants with modulated drought sensitivity
MGNCAGVEGNAEINPSFSAPNSSGTAGSKSVSKNAADTGTFGTKTSGSSSSVPPTPRTEAEILESSNVRKFSFGELKGSTRNFRPDSLLGEGGFGSVFKGWMDERTLAPVRPGAGIIVAVKKLKLDSFQGHREWLAEVNYLGQLSHPNLVKLIGYCLEDEQRLLVYEYMPRGSLEHHLFRRGSNFQPLPWNLRMKVALEAARGLAFLHGDQAKVIYRDFKTSNILLDSEYNAKLSDFGLAKDGPSGDKSHVSTRVMGTQGYAAPEYLATGHLTAKSDVYSYGVVLLELLSGQRALDKNRPPGQHNLVEWARPYITNKRRVIHVLDSRLGSQYSLPAAQKVATLALQCLSMDARCRPAMDQVVTALEQLQRPRAH

SEQ ID NO: 50266 - protein, 776 aa, Arabidopsis thaliana
  misc_feature: Useful for making plants with altered cell wall content and/or composition
MAAKRSIYCLLLLPLLLSLLIWIPSISLAATNPDDVAAINGLFAALGAPVLPGWIASGGDPCGEAWQGIICNVSDIISITVNAANLQGELGDNLAKFTSIRGIDFSNNRIGGSIPSTLPVTLQHFFLSANQFTGSIPESLGTLSFLNDMSLNDNLLSGELPDVFQNLVGLINLDISSNNISGTLPPSMENLLTLTTLRVQNNQLSGTLDVLQGLPLQDLNIENNLFSGPIPDKLLSIPKFLHEGNPFNATMINSTSTAPSLSPSLSPTKPAPTRPFSGVPPPPNERNRGKVADGPSDSEGSSSENSKGKNSSHTKKIILIAFAGVLVFIILVLAILLLLPKCARRREHANRVFKPHQVGADRGSRENALENGTPVLPPPGRSEKVQREPFKKAGEEPKVLHDLERLRRPAPISRQESQDIDFSMLMPPPPPPPPPPPPPPLDEKVTVMPIISPERPVKKTSPKRLPLTSVKHYSIASLQQYTESFAQENLIGSGMLGSVYRARLPNGKLFAVKKLDKRASEQQQDHEFIELVNNIDMIRHSNIVELVGYCAEHDQRLLVYEYCSNGTLQDGLHSDDEFKKKLSWNTRVSMALGAARALEYLHEVCEPPIIHRNFKSANVLLDDDLSVLVSDCGLAPLISSGSVSQLSGQLLAAYGYGAPEFDSGIYTWQSDVYSFGVVMLELLTGRMSYDRDRSRGEQFLVRWAIPQLHDIDALGKMVDPSLNGQYPAKSLSHFADIISRCVQSEPEFRPLMSEVVQDLLDMIRRERHGSGDSTAD

SEQ ID NO: 50267 - protein, 345 aa, Arabidopsis thaliana
  misc_feature: Useful for making plants with modulated heat sensitivity
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 50268 - protein, 377 aa, Arabidopsis thaliana
  misc_feature: Useful for making plants with modulated heat sensitivity
  misc_feature: Useful for making plants with modulated low light sensitivity
  misc_feature: Useful for making plants with modulated nitrogen use efficiency
MPGEQTGETPTVAGVGGGGAGCSAGNSGGSSGCGAGGGGGGSGGGGGGGGDSQRSIPTPFLTKTYQLVEDPVYDELISWNEDGTTFIVWRPAEFARDLLPKYFKHNNFSSFVRQLNTYGFRKVVPDRWEFSNDCFKRGEKILLRDIQRRKISQPAMAAAAAAAAAAVAASAVTVAAVPVVAHIVSPSNSGEEQVISSNSSPAAAAAAIGGVVGGGSLQRTTSCTTAPELVEENERLRKDNERLRKEMTKLKGLYANIYTLMANFTPGQEDCAHLLPEGKPLDLLPERQEMSEAIMASEIETGIGLKLGEDLTPRLFGVSIGVKRARREEELGAAEEEDDDRREAAAQEGEQSSDVKAEPMEENNSGNHNGSWLELGK

SEQ ID NO: 50269 - protein, 816 aa, Panicum virgatum; identical to SEQ ID NO: 3276
  misc_feature: Useful for making plants with altered carbohydrate content

SEQ ID NO: 50270 - protein, 618 aa, Arabidopsis thaliana
  misc_feature: Useful for making plants with altered cell wall content and/or composition
MANAERMITRVHSQRERLNETLVSERNEVLALLSRVEAKGKGILQQNQIIAEFEALPEQTRKKLEGGPFFDLLKSTQEAIVLPPWVALAVRPRPGVWEYLRVNLHALVVEELQPAEFLHFKEELVDGVKNGNFTLELDFEPFNASIPRPTLHKYIGNGVDFLNRHLSAKLFHDKESLLPLLKFLRLHSHQGKNLMLSEKIQNLNTLQHTLRKAEEYLAELKSETLYEEFEAKFEEIGLERGWGDNAERVLDMIRLLLDLLEAPDPCTLETFLGRVPMVFNVVILSPHGYFAQDNVLGYPDTGGQVVYILDQVRALEIEMLQRIKQQGLNIKPRILILTRLLPDAVGTTCGERLERVYDSEYCDILRVPFRTEKGIVRKWISRFEVWPYLETYTEDAAVELSKELNGKPDLIIGNYSDGNLVASLLAHKLGVTQCTIAHALEKTKYPDSDIYWKKLDDKYHFSCQFTADIFAMNHTDFIITSTFQEIAGSKETVGQYESHTAFTLPGLYRVVHGIDVFDPKFNIVSPGADMSIYFPYTEEKRRLTKFHSEIEELLYSDVENKEHLCVLKDKKKPILFTMARLDRVKNLSGLVEWYGKNTRLRELANLVVVGGDRRKESK

SEQ ID NO: 50271 - protein, 532 aa, Arabidopsis thaliana
  misc_feature: Useful for making plants with altered cell wall content and/or composition
MVFNVVILSPHGYFAQDNVLGYPDTGGQVVYILDQVRALETEMLQRIKQQGLNITPRILIITRLLPDAAGTTCGQRLEKVYGSQYCDILRVPFRTEKGIVRKWISRFEVWPYLETFTEDVAAEISKELQGKPDLIIGNYSDGNLVASLLAHKLGVTQCTIAHALEKTKYPDSDIYWKKLDEKYHFSCQFTADLIAMNHTDFIITSTFQEIAGSKDTVGQYESHRSFTLPGLYRVVHGIDVFDPKFNIVSPGADMSIYFAYTEEKRRLTAFHLEIEELLYSDVENEEHLCVLKDKKKPIIFTMARLDRVKNLSGLVEWYGKNTRLRELVNLVVVGGDRRKESQDNEEKAEMKKMYELIEEYKLNGQFRWISSQMNRVRNGELYRYICDTKGAFVQPALYEAFGLTVVEAMTCGLPTFATCNGGPAEIIVHGKSGFHIDPYHGDKAAESLADFFTKCKHDPSHWDQISLGGLERIQEKYTWQIYSQRLLTLTGVYGFWKHVSNLDRLESRRYLEMFYALKYRPLAQAVPLAHEE

SEQ ID NO: 50272 - protein, 485 aa, Zea mays; identical to SEQ ID NO: 9371
  misc_feature: Useful for making plants with modulated oxidative stress sensitivity

SEQ ID NO: 50273 - protein, 359 aa, Arabidopsis thaliana
  misc_feature: Useful for making plants with modulated water use efficiency
MKNGQCAQELQSSTQASHDSQGDQKTNLSIDAPIQDSGSVSASSNDSRKVSRQDIELVQNLIERCLQLYMNRDEVVKTLLTRARIDPGFTTLVWQKLEEENADFFRAYYIRLKLKKQIILFNHLLEHQYHLMKYPPGPPKVPLAPIQNGMHPMAPVNMPMGYPVLQHPQMHVPGHPHHLDAMGVSSCHVVNGVPAPANFHPLRMNTANDMVIDTTANDATPQVIPPNSGAMPEMVASPASVASSGHFPFAASDMSGMVMDTSVLDSAFTSDVGPDGEGAGNSRDSLRSFDQIPWNFSLSDLTADLSNLGDLGALGNYPGSPFLPSDSEIFLDSPEQEDIEEFFVDSVPGPRSNSDEEKP

SEQ ID NO: 50274 - protein, 296 aa, Arabidopsis thaliana
  misc_feature: Useful for making plants with modulated drought sensitivity
  misc_feature (106)..(106): Xaa is any aa, unknown, or other
  misc_feature (282)..(282): Xaa is any aa, unknown, or other
MKNGQCAQELQSSTQASHDSQGDQKTNLSIDAPIQDSGSVSASSNDSRKVSRQDIELVQNLIERCLQLYMNRDEVVKTLLTRARIDPGFTTLVWQKLEEENADFFXAYYIRLKLKKQIILFNHLLEHQYHLMKYPPGPPKVPLAPIQNGMHPMAPVNMPMGYPVLQHPQMHVPGHPHHLDAMGVSSCHVVNGVPAPANFHPLRMNTANDMVIDTTANDATPQVIPPNSGAMPEMVASPASVASSGHFPFAASDMSGMVMDTSVLDSAFTSDVGPDGEGAGNXRDSLRSFDQIPWKL

SEQ ID NO: 50275 - protein, 268 aa, Panicum virgatum
  misc_feature: Useful for making plants with altered carbohydrate content
  misc_feature (148)..(148): Xaa is any aa, unknown, or other
  misc_feature (154)..(154): Xaa is any aa, unknown, or other
  misc_feature (182)..(182): Xaa is any aa, unknown, or other
MARAGALCLALLCLLAAHSAVAQKSATPAPAAAPAAATTPPAPSKKTPAPAAAPPTTPAPATAPPTTPATPAPAAAPPTTTTPAPAAAPPKSSPKAATPAPAPKAKATPPATPPVAELPPAATPPAPAADTPAAAPTKPAEAPAPAPXKKKKKXPPAKSKKKKSKAPAPAPAAEAPTTPKHXKAKAPAPSEADAPGPAGDGDAAETAGAGRTAAGGNKAAGPGPAAHPAQRHGRRTHARGSGTTGPAAPPADGTTRPPTRPHDRSTRP

SEQ ID NO: 50276 - protein, 568 aa, Panicum virgatum; identical to SEQ ID NO: 10924
  misc_feature: Useful for making plants with altered carbohydrate content

SEQ ID NO: 50277 - protein, 273 aa, Zea mays; identical to SEQ ID NO: 9438
  misc_feature: Useful for making plants with modulated biomass

SEQ ID NO: 50278 - protein, 170 aa, Panicum virgatum; identical to SEQ ID NO: 3374
  misc_feature: Useful for making plants with altered carbohydrate content

SEQ ID NO: 50279 - protein, 491 aa, Panicum virgatum; identical to SEQ ID NO: 5146
  misc_feature: Useful for making plants with altered carbohydrate content

SEQ ID NO: 50280 - protein, 456 aa, Panicum virgatum; identical to SEQ ID NO: 10978
  misc_feature: Useful for making plants with altered carbohydrate content

SEQ ID NO: 50281 - protein, 673 aa, Arabidopsis thaliana
  misc_feature: Useful for making plants with altered cell wall content and/or composition
MALKRGLSGVNRIRGSGGGSRSVLVLLIFFCVFAPLCFFVGRGVYIDSSNDYSIVSVKQNLDWRERLAMQSVRSLFSKEILDVIATSTADLGPLSLDSFKKNNLSASWRGTGVDPSFRHSENPATPDVKSNNLNEKRDSISKDSIHQKVETPTKIHRRQLREKRREMRANELVQHNDDTILKLENAAIERSKSVDSAVLGKYSIWRRENENDNSDSNIRLMRDQVIMARVYSGIAKLKNKNDLLQELQARLKDSQRVLGEATSDADLPRSAHEKLRAMGQVLAKAKMQLYDCKLVTGKLRAMLQTADEQVRSLKKQSTFLAQLAAKTIPNPIHCLSMRLTIDYYLLSPEKRKFPRSENLENPNLYHYALFSDNVLAASVVVNSTIMNAKDPSKHVFHLVTDKLNFGAMNMWFLLNPPGKATIHVENVDEFKWLNSSYCPVLRQLESAAMREYYFKADHPTSGSSNLKYRNPKYLSMLNHLRFYLPEVYPKLNKILFLDDDIIVQKDLTPLWEVNLNGKVNGAVETCGESFHRFDKYLNFSNPHIARNFNPNACGWAYGMNMFDLKEWKKRDITGIYHKWQNMNENRTLWKLGTLPPGLITFYGLTHPLNKAWHVLGLGYNPSIDKKDIENAAVVHYNGNMKPWLELAMSKYRPYWTKYIKFDHPYLRRCNLHE

SEQ ID NO: 50282 - protein, 450 aa, Panicum virgatum; identical to SEQ ID NO: 16689
  misc_feature: Useful for making plants with altered carbohydrate content

SEQ ID NO: 50283 - protein, 587 aa, Arabidopsis thaliana; identical to SEQ ID NO: 9671
  misc_feature: Useful for making plants with altered carbon content
  misc_feature: Useful for making plants with altered nitrogen content

SEQ ID NO: 50284 - protein, 345 aa, Zea mays
  misc_feature: Useful for making plants with modulated nitrogen use efficiency
MGYLWRVRLSSFAAGAATASAAGFFLLYKDHLLARAADAESNSASYSPPLATADTAFSAPPRAVAPADLQLSGSYASDIYTYLRSLEVDPQRRSRSDYIEAVQADVTAHMRSILVDWLVEVAEEYKLVADTLYLTISYVDRFLSVNALGRDKLQLLGVASMLIAAKFEEISPPHPEDFCYITDNTYTKEELLKMESDILKLLKFELGNPTIKTFLRRFIRSAHEDKKGSILLMEFLGSYLAELSLLDYGCLRFLPSVVAASVMFVARLTIDPNTNPWNTKLQKMTGYKVSELKDCIVAIHDLQLNRKCPSLTAIRDKYKQHKFKCVSLILVPVVIPTSYFEDLAE

SEQ ID NO: 50285 - protein, 113 aa, Arabidopsis thaliana
  misc_feature: Useful for making plants with altered oil content
  misc_feature: Useful for making plants with modulated biomass
MKVAAAFLLAVLGGNANPSAENIKDIIGAVGADVDGESIELLLKEVSGKDIAELIASGREKLASVPSGGGVAVSAAPSSGGGGAAAAAPAEKKEAKKEEKEESDDDMGFSLFE

SEQ ID NO: 50286 - protein, 512 aa, Panicum virgatum; identical to SEQ ID NO: 8552
  misc_feature: Useful for making plants with altered carbohydrate content

SEQ ID NO: 50287 - protein, 508 aa, Arabidopsis thaliana
  misc_feature: Useful for making plants with altered lignin content
MSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRKYLGAVAFNNITRLAFGKRFMNAEGVVDEQGLEFKAIVSNGLKLGASLSIAEHIPWLRWMFPADEKAFAEHGARRDRLTRAIMEEHTLARQKSSGAKQHFVDALLTLKDQYDLSEDTIIGLLWDMITAGMDTTAITAEWAMAEMIKNPRVQQKVQEEFDRVVGLDRILTEADFSRLPYLQCVVKESFRLHPPTPLMLPHRSNADVKIGGYDIPKGSNVHVNVWAVARDPAVWKNPFEFRPERFLEEDVDMKGHDFRLLPFGAGRRVCPGAQLGINLVTSMMSHLLHHFVWTPPQGTKPEEIDMSENPGLVTYMRTPVQAVATPRLPSDLYKRVPYDM

SEQ ID NO: 50288 - protein, 172 aa, Arabidopsis thaliana
  misc_feature: Useful for making plants with altered cell wall content and/or composition
MSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRK

SEQ ID NO: 50289 - protein, 487 aa, Arabidopsis thaliana
  misc_feature: Useful for making plants with modulated light sensitivity
MDLLLISLTTIIIAAYMQNLRRRGSNIPPGPPTRFLVGNLHQLKPLWTQSFSEWSQTYGPIISVWLGSQLAVVVSSSDLAKQVLRDKDYQLCNRHRTARMTQNGSDLIWSDYGAHYVKMRKLCTLELFSLKSIECFRSMREMEVSSMVKSIFNDFMSDDQKPVVLRNYLDSVALNIVSRLVIGKTFEPKDGREFRSIVERETRLPGATKMLDYTVWLKRLSSWFTSDKAFMKHMARKRNWFKRAVMDEVYGGRDQKCFVQSLLELKEKDELTEETVMGLVWNMLTAGADTTAITIEWAMAEMIRCPTVKEKVQDELDSVVGSGRLMSDADIPKLPFLQCVLKEALRLHPPTPLMLPHKASESVQVGGYKVPKGATVYVNVQAIARDPANWSNPDEFRPERFLVEETDVKGQDFRVLPFGSGRRVCPAAQLSLNMMTLALGSLLHCFSWTSSTPREHIDMTEKPGLVCYMKAPLQALASSRLPQELYL

SEQ ID NO: 50290 - protein, 349 aa, Arabidopsis thaliana
  misc_feature: Useful for making plants with altered cell wall content and/or composition
  misc_feature: Useful for making plants with altered lignin content
MREMEVSSMVKSIFNDFMSDDQKPVVLRNYLDSVALNIVSRLVIGKTFEPKDGREFRSIVERETRLPGATKMLDYTVWLKRLSSWFTSDKAFMKHMARKRNWFKRAVMDEVYGGRDQKCFVQSLLELKEKDELTEETVMGLVWNMLTAGADTTAITIEWAMAEMIRCPTVKEKVQDELDSVVGSGRLMSDADIPKLPFLQCVLKEALRLHPPTPLMLPHKASESVQVGGYKVPKGATVYVNVQAIARDPANWSNPDEFRPERFLVEETDVKGQDFRVLPFGSGRRVCPAAQLSLNMMTLALGSLLHCFSWTSSTPREHIDMTEKPGLVCYMKAPLQALASSRLPQELYL

SEQ ID NO: 50291 - protein, 350 aa, Arabidopsis thaliana
  misc_feature: Useful for making plants with modulated nitrogen use efficiency
MSSTAASSTVGGGGSSEISGVKKTSKRPKYSRFTQQELPACKPILTPRWVILTFLVAGVVFIPLGVICLFASQGVVEIVDRYDTDCIPTSSRNNMVAYIQGEGDKICKRTITVTKAMKHPVYVYYQLENFYQNHRRYVKSRNDAQLRSPKEEHDVKTCAPEDNVGGEPIVPCGLVAWSLFNDTYSFSRNSQQLLVNKKGISWKSDRENKFGKNVFPKNFQKGAPIGGGTLNISKPLSEQEDLIVWMRTAALPTFRKLYGKIETDLHAGDTITVLLQNNYNTYSFNGQKKLVLSTTSWLGGRNDFLGIAYLTVGSICLFLAVTFAVLYLVKPRQLGDPSYLSWNRSAGGLQ

SEQ ID NO: 50292 - protein, 371 aa, Arabidopsis thaliana
  misc_feature: Useful for making plants with altered cell wall content and/or composition
MSVSIPVLMKRLCLYNSLSLFLFHLFPSPSLALSFSVELNLLKAQMVWANAKMRLALSLVTVFFGISLANLEVGFYSNTCPQAESIVKRVVSGAALSDPNLPAILLRLHFHDCFVEGCDGSILVNNGAISEKNAFGHEGVRGFEIVEAVKAELEAACPGVVSCSDIVALAARDAISLANGPAYEVPTGRRDGRVSNMSLAKDMPEVSDSIEILKAKFMQKGLNAKDLVLLSAAHTIGTTACFFMSKRLYDFLPGGQPDPTINPTFLPELTTQCPQNGDINVRLPIDRFSERLFDKQILQNIKDGFAVLQTDAGLYEDVTTRQVVDSYLGMLNPFFGPTFESDFVKAIVKMGKIGVKTGFKGEIRRVCSAFN

SEQ ID NO: 50293 - protein, 518 aa, Arabidopsis thaliana; identical to SEQ ID NO: 9729
  misc_feature: Useful for making plants with modulated biomass

SEQ ID NO: 50294 - protein, 510 aa, Arabidopsis thaliana
  misc_feature: Useful for making plants with altered cell wall content and/or composition
MAHRRLIMTMTKMMMMVTMMMMMDKTCICADISRGSFPKGFVFGTASSAFQHEGAVKAEGRGPTIWDTFSHTFGKITDFSNADVAVDQYHRYEEDVQLMKNMGMDAYRFSISWTRIFPNGVGHINEAGIDHYNKLINALLAKGIEPYVTLYHWDLPQALHDRYLGWLNPQIINDFAAYAEVCFQRFGDRVKHWITFNEPHTFAIQGYDVGLQAPGRCTILFKLTCREGNSSTEPYIVGHNVILTHATVSDIYRKKYKAKQGGSLGIAFDVMWFEPESNKTEDIEAAQRAQDFQLGWFLDPLMFGDYPSSMRSRVGSRLPVFTGSQSSLVKGSLDFVGINHYTTYYARNNATNLIGTLLHDAVSDSGTVTLPFKGLSTIGDRASSIWLYIVPRGMRSLMNYIKHRYGNPPVFITENGMDDPNSILISRKDALKDAKRIKYHHDYLSSLQASIKEDGCNVKGYFVWSLLDNWEWAAGYSSRFGLYFVDYRDNLKRYPKDSVHWFTSFLNSTS

SEQ ID NO: 50295 - protein, 498 aa, Panicum virgatum; identical to SEQ ID NO: 3700
  misc_feature: Useful for making plants with altered carbohydrate content

SEQ ID NO: 50296 - protein, 456 aa, Panicum virgatum; identical to SEQ ID NO: 8102
  misc_feature: Useful for making plants with altered carbohydrate content

SEQ ID NO: 50297 - protein, 140 aa, Arabidopsis thaliana [sequence omitted]

SEQ ID NO: 50298 - protein, 361 aa, Zea mays; identical to SEQ ID NO: 9653
  misc_feature: Useful for making plants with modulated drought sensitivity

SEQ ID NO: 50299 - protein, 374 aa, Arabidopsis thaliana
  misc_feature: Useful for making plants with modulated flowering time
  misc_feature: Useful for making plants with modulated low light sensitivity
MTNQNVIVSDRKPILGLKTITVSVSNSPLFSNSFPTYFNFPRRKLLKLLEAADKNNLVVAPKITSMIDSMRDSSPTRLRSSSYDSVSDNDDKTSWIVRFPSALNMFDEIVNAAKGKQIVMFLDYDGTLSPIVEDPDKAFITHEMREVVKDVASNFPTAIVTGRSIEKVRSFVQVNEIYYAGSHGMDIEGPTNENSNGQSNERVLFQPAREFLPMIEKVVNILEEKTKWIPGAMVENNKFCLSVHFRRVDEKRWPALAEVVKSVLIDYPKLKLTQGRKVLEIRPTIKWDKGQALNFLLKSLGYENSDDVVPVYIGDDRTDEDAFKVLRERGQGFGILVSKVPKDTNASYSLQDPSQVNKFLERLVEWKRKTVGEE

SEQ ID NO: 50300 - protein, 385 aa, Arabidopsis thaliana; identical to SEQ ID NO: 9630
  misc_feature: Useful for making plants with modulated drought sensitivity
  misc_feature: Useful for making plants with modulated flowering time
  misc_feature: Useful for making plants with modulated water use efficiency

SEQ ID NO: 50301 - protein, 324 aa, Arabidopsis thaliana; identical to SEQ ID NO: 9257
  misc_feature: Useful for making plants with modulated heat sensitivity

SEQ ID NO: 50302 - protein, 265 aa, Arabidopsis thaliana; identical to SEQ ID NO: 9477
  misc_feature: Useful for making plants with modulated light quality response
  misc_feature: Useful for making plants with modulated nitrogen use efficiency

SEQ ID NO: 50303 - protein, 254 aa, Arabidopsis thaliana
  misc_feature: Useful for making plants with modulated nitrogen use efficiency
MVIINPNNPCGNVYTYDHLNKVAEMARKLGIMIISDEVYDHVVYGDKPFIPMGKFASIAPVITLGSISKGWVNPGWRVGWIAMNDPNGIFVSTGVVQAIEDFLDLTPQPSFILQEALPDILEKTPKEFFEKKIKAMRRNVELSCERLKDIPCLFCPKKPESCSYLWLKLDTSMLNNIKNDFDFCTKLVSEESLILIPGVALGAENWVRISIGTDESVVQEIFDRLKGFYDRHAISKEAIKLSGHAINQIVVSVN

SEQ ID NO: 50304 - protein, 519 aa, Panicum virgatum; identical to SEQ ID NO: 19938
  misc_feature: Useful for making plants with altered carbohydrate content

SEQ ID NO: 50305 - protein, 474 aa, Arabidopsis thaliana
  misc_feature: Useful for making plants with modulated biomass
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKGAQQVNLPVPEGCTDPVAENFDPTARSDDGTCVYNF

SEQ ID NO: 50306 - protein, 402 aa, Panicum virgatum; identical to SEQ ID NO: 198
  misc_feature: Useful for making plants with altered carbohydrate content

SEQ ID NO: 50307 - protein, 427 aa, Arabidopsis thaliana; identical to SEQ ID NO: 9221
  misc_feature: Useful for making plants with altered lignin content

SEQ ID NO: 50308 - protein, 340 aa, Panicum virgatum; identical to SEQ ID NO: 11260
  misc_feature: Useful for making plants with altered carbohydrate content

SEQ ID NO: 50309 - protein, 344 aa, Arabidopsis thaliana
  misc_feature: Useful for making plants with altered cell wall content and/or composition
MAPGLTQTADAMSTVTITKPSLPSVQDSDRAYVTFLAGNGDYVKGVVGLAKGLRKVKSAYPLVVAMLPDVPEEHRRILVDQGCIVREIEPVYPPENQTQFAMAYYVINYSKLRIWKFVEYSKMIYLDGDIQVYENIDHLFDLPDGYLYAVMDCFCEKTWSHTPQYKIRYCQQCPDKVQWPKAELGEPPALYFNAGMFLYEPNLETYEDLLRTLKITPPTPFAEQDFLNMYFKKIYKPIPLVYNLVLAMLWRHPENVELGKVKVVHYCAAGSKPWRYTGKEANMEREDIKMLVKKWWDIYDDESLDYKKPVTVVDTEVDLVNLKPFITALTEAGRLNYVTAPSAA

SEQ ID NO: 50310 - protein, 335 aa, Arabidopsis thaliana
  misc_feature: Useful for making plants with modulated water use efficiency
MAPEINTKLTVPVHSATGGEKRAYVTFLAGTGDYVKGVVGLAKGLRKAKSKYPLVVAVLPDVPEDHRKQLVDQGCVVKEIEPVYPPENQTEFAMAYYVINYSKLRIWEFVEYNKMIYLDGDIQVFDNIDHLFDLPNGQFYAVMDCFCEKTWSHSPQYKIGYCQQCPDKVTWPEAKLGPKPPLYFNAGMFVYEPNLSTYHNLLETVKIVPPTLFAEQDFLNMYFKDIYKPIPPVYNLVLAMLWRHPENIELDQVKVVHYCAAGAKPWRFTGEEENMDREDIKMLVKKWWDIYNDESLDYKNVVIGDSHKKQQTLQQFIEALSEAGALQYVKAPSAA

SEQ ID NO: 50311 - protein, 2150 aa, Arabidopsis thaliana
  misc_feature: Useful for making plants with modulated biomass
  misc_feature: Useful for making plants with modulated seed size
MASSEVSMKGNRGGDNFSSSGFSDPKETRNVSVAGEGQKSNSTRSAAAERALDPEAALYRELWHACAGPLVTVPRQDDRVFYFPQGHIEQASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVMASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNSPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNSMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 50312 - protein, 602 aa, Arabidopsis thaliana
  misc_feature: Useful for biocontainment applications
  misc_feature: Useful for making plants with modulated flowering time
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 50313 - protein, 859 aa, Arabidopsis thaliana
  misc_feature: Useful for making plants with modulated seed size
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 50314 - protein, 90 aa, Oryza sativa subsp. japonica
  misc_feature: Useful for making plants with modulated flowering time
MSKARVYADVNVLRPKEYWDYEALTVQWGEQDDYEVVRKVGRGKYSEVFEGINVNNNEKCIIKILKPVKKKKIKREIKILQNLCGGPNIV

SEQ ID NO: 50315 - protein, 480 aa, Panicum virgatum; identical to SEQ ID NO: 11323
  misc_feature: Useful for making plants with altered carbohydrate content

SEQ ID NO: 50316 - protein, 415 aa, Zea mays; identical to SEQ ID NO: 9495
  misc_feature: Useful for making plants with altered lignin content

SEQ ID NO: 50317 - protein, 469 aa, Arabidopsis thaliana
  misc_feature: Useful for making plants with modulated biomass
MEESNRSSTVLFDKYNIGRLLGTGNFAKVYHGTEISTGDDVAIKVIKKDHVFKRRGMMEQIEREIAVMRLLRHPNVVELREVMATKKKIFFVMEYVNGGELFEMIDRDGKLPEDLARKYFQQLISAVDFCHSRGVFHRDIKPENLLLDGEGDLKVTDFGLSALMMPEGLGGRRGSSDDLLHTRCGTPAYVAPEVLRNKGYDGAMADIWSCGIVLYALLAGFLPFIDENVMTLYTKIFKAECEFPPWFSLESKELLSRLLVPDPEQRISMSEIKMIPWFRKNFTPSVAFSIDETIPSPPEPPTKKKKKDLNEKEDDGASPRSFNAFQFITSMSSGFDLSNLFEIKRKPKRMFTSKFPAKSVKERLETAAREMDMRVKHVKDCKMKLQRRTEGRKGRLSVTAEVFEVAPEVSVVEFCKTSGDTLEYYLFCEDDVRPALKDIVWSWQGDDDEDDVTTNDNVDTNDNKINNVS

SEQ ID NO: 50318 - protein, 512 aa, Arabidopsis thaliana
  misc_feature: Useful for making plants with modulated cold sensitivity
MEISVASVTISVVLAVVSWWIWRTLQWVWFKPKMLEHYLRRQGLAGTPYTPLVGDLKKNFTMLSEARSKPLKLTDDISPRVVPYPLQMFKTYGRTYFTWFGPIPTITIMDPEQIKEVFNKVYDFQKPHTFPLATIIAKGLANYDGDKWAKHRRIINPAFHIEKIKNMVPAFHQSCREVVGEWDQLVSDKGSSCEVDVWPGLVSMTADVISRTAFGSSYKEGQRIFELQAELAQLIIQAFRKAFIPGYSYLPTKSNRRMKAAAREIQVILRGIVNKRLRAREAGEAPSDDLLGILLESNLRQTEGNGMSTEDLMEECKLFYFAGQETTSVLLVWTMVLLSQHQDWQARAREEVKQVFGDKEPDAEGLNQLKVMTMILYEVLRLYPPVTQLTRAIHKELKLGDLTLPGGVQISLPILLVQHDIELWGNDAAEFNPDRFKDGLSKATKSQVSFFPFAWGPRICIGQNFALLEAKMAMALILRRFSFEISPSYVHAPYTVITIHPQFGAQLIMHKL

SEQ ID NO: 50319 - protein, 512 aa, Arabidopsis thaliana
  misc_feature: Useful for making plants with modulated nitrogen use efficiency
MEISVASVTVSVAVVVVSWWVWRTLQRVWLKPKMLESYLRRQGLAGTPYTPLVGDLKRNFSMLAEARSKPINLTDDITPRIVPYPLQMLKTHGRTFFTWFGPIPTITIMDPEQIKEVFNKVYDFQKAHTFPLGRLIAAGLVSYDGDKWTKHRRIINPAFHLEKIKNMVPAFHQSCSEIVGEWDKLVTDKQSSCEVDIWPWLVSMTADVISRTAFGSSYKEGQRIFELQAELAQLIIQAFRKAIIPGYRYFPTKGNRRMKAAAREIKFILRGIVNKRLRAREAGEAPSDDLLGILLESNLGQTKGNGMSTEELMEECKLFYFAGQETTTVLLVWTMVLLSQHQDWQARAREEVKQVFGDKEPDAEGLNQLKVMTMILYEVLRLYPPVVQLTRAIHKEMQLGDLTLPGGVQISLPILLIQRDRELWGNDAGEFKPDRFKDGLSKATKNQVSFFPFAWGPRICIGQNFALLEAKMAMTLILRKFSFELSPSYVHAPYTVLTTHPQFGAPLILHKL

SEQ ID NO: 50320 - protein, 508 aa, Arabidopsis thaliana
  misc_feature: Useful for biocontainment applications
  misc_feature: Useful for making plants with modulated biomass
  misc_feature: Useful for making plants with modulated flowering time
MEIVIASLALVVVLWCIWRILEWVWLKPKMLESYLRRQGLVGTRYTPLVGDVRRSFSMLKEARSKPMKPTDDLISLVMPYSFHMLNTYGKTFFTWSGPIPAITIMNPQLIKEVYNKFYDFEKTHTFPLTSLLTDGLANADGDKWVKHRKIINPAFHFEKIKNMVPTFYKSCIEVMCEWEKLVSDKGSSCELDVWPWIVNMTGDVISRTAFGSSYKEGQRIFILQAELAHLIILALGKNYIPAYRHFPTKNNRRMKTIVKEIQVILRGIISHREKARDAGEAPSDDLLGILLKSNSEQSKGNGLNMEEIMEECKLFYFAGQETTSVLLAWTMVLLSQHQDWQARAREEVMQVFGHNKPDLQGINQLKVMTMIIYEVLRLYPPVIQMNRATHKEIKLGDMTLPGGIQVHMPVLLIHRDTKLWGDDAAEFKPERFKDGIAKATKNQVCFLPFGWGPRICIGQNFALLEAKMALALILQRFSFELSPSYVHSPYRVFTIHPQCGAHLILHKL

SEQ ID NO: 50321 - protein, 505 aa, Arabidopsis thaliana [sequence omitted]

SEQ ID NO: 50322 - protein, 192 aa, Arabidopsis thaliana
  misc_feature: Useful for making plants with modulated oxidative stress sensitivity
MENMGDSSIGPGHPHLPPGFRFHPTDEELVVHYLKKKAASVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQRPTMERVLERI

SEQ ID NO: 50323 - protein, 320 aa, Arabidopsis thaliana
  misc_feature: Useful for making plants with altered cell wall content and/or composition
  misc_feature: Useful for making plants with altered lignin content
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 50324 - protein, 340 aa, Glycine max
  misc_feature: Useful for making plants with altered terpenoid content
MGVPERDPLAQLSLPPGFRFYPTDEELLVQYLCRKVAGHHFSLPIIAEVDLYKFDPWVLPGKAAFGEKEWYFFSPRDRKYPNGSRPNRVAGSGYWKATGTDKIITTEGRKVGIKKALVFYVGKAPKGSKTNWIMHEYRLLDSSRKHNLGTAKLDDWVLCRIYKKNSSAQKVEANLLAMECSNGSSPSSSSHVDDMLESLPEIDDRCFTLPRVNSVRTMQQQDEKFGFQNMGSGFFTDWVNPTDLDSVSEFGSGCQTQGMVNYDCNDLFVPSVPPFGHSHVNYMVGAPPSEEEVQSGVRTQQADGAACFQQNPNARLLPGSGDPFGFGFIMGQQVEFGFRD

SEQ ID NO: 50325 - protein, 317 aa, Arabidopsis thaliana
  misc_feature: Useful for making plants with modulated water use efficiency
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 50326 - protein, 317 aa, Arabidopsis thaliana; identical to SEQ ID NO: 50325
  misc_feature: Useful for making plants with modulated light quality response

SEQ ID NO: 50327 - protein, 343 aa, Oryza sativa
  misc_feature: Useful for making plants with modulated light quality sensitivity
MEQHQGQAGMDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 50328 - protein, 252 aa, Arabidopsis thaliana
  misc_feature: Useful for making plants with modulated nitrogen use efficiency
MDNVKLVKNGVLRLPPGFRFHPTDEELVVQYLKRKVCSSPLPASIIPEFDVCRADPWDLPGNLEKERYFFSTREAKYPNGNRSNRATGSGYWKATGIDKRVVTSRGNQIVGLKKTLVFYKGKPPHGSRTDWIMHEYRLSSSPPSSMGPTQNWVLCRIFLKKRAGNKNDDDDGDSRNLRHNNNNNSSDQIEIITTDQTDDKTKPIFFDFMRKERTTDLNLLPSSPSSDHASSGVTTEIFSSSDEETSSCNSFR

SEQ ID NO: 50329 - protein, 89 aa, Arabidopsis thaliana
  misc_feature: Useful for making plants with altered lignin content
MASKALILLGLFSVLLVVSEVSAARQSGMVKPESEETVQPEGYGGGHGGHGGHGGGGGHGHGGHNGGGGGHHGGGGHGLNEPVQTKPGV

SEQ ID NO: 50330 - protein, 826 aa, Panicum virgatum; identical to SEQ ID NO: 24898
  misc_feature: Useful for making plants with altered carbohydrate content

SEQ ID NO: 50331 - protein, 842 aa, Embryophyta
  misc_feature: Useful for making plants with altered lignin content
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 50332 - protein, 494 aa, Glycine max
  misc_feature: Useful for making plants with altered alkaloid content
  misc_feature: Useful for making plants with altered terpenoid content
MTRLTRDFGDTMQRDAVPAVSSDVVFASSRFPNYRIGANNQIIETKDDPKVLSMKEVVARETAQLLEQHNRLSVRDLASKFEKGLAAAAKLSEEARLREAASLEKHVLLKKLRDALESLKGRVAGRNKDDVEEAIAMVEALAVQLTQREGELIQEKAEVKKLANFLKQASEDAKKLVDEERAFARAEIEDARAAVQRVEEALQEHERMSQASGKQDLEQLMREVQEARRIKMLHQPSKVMDMEHELRALRSQLAEKTRQYLRLQKELTRTKKGGENVPHLYELEGNETLGSYLQIQPCSDNAPEVSKCSIQWYRVSSDGAKKELISGATKSVYAPEPFDVGRILQVDIISESEHVTLSTAGPIDPAAGLGTYVEALVRKHDTEFNVVVTQMNGSHHPTESIHVLHVGKMRIKLCKGKTTIAKEYYSSSMQLCGVRGGGNAAAQALFWQPKQGHSFVLAFESERERNAAIMLARRFAFDCNIMLAGPDDRAPLGT

SEQ ID NO: 50333 - protein, 128 aa, Arabidopsis thaliana
  misc_feature: Useful for making plants with modulated biomass
  misc_feature (98)..(98): Xaa is any aa, unknown, or other
  misc_feature (100)..(100): Xaa is any aa, unknown, or other
  misc_feature (105)..(105): Xaa is any aa, unknown, or other
  misc_feature (106)..(106): Xaa is any aa, unknown, or other
  misc_feature (116)..(116): Xaa is any aa, unknown, or other
MGRGRVELKRIENKINRQVTFAKRRNGLLKKAYELSVLCDAEVALIIFSNRGKLYEFCSSSSMLRTLERYQKCNYGAPEPNVPSREALAELSSQQEYXKXKEAVXXPYREPQRNLXGEDLGPLSDKGA

SEQ ID NO: 50334 - protein, 310 aa, Panicum virgatum
  misc_feature: Useful for making plants with altered carbohydrate content
MARPVQQAAALLPLLLACTLALLTLQLRPCAGQQQPPSPGYYPSATLRPLAFSEGYRTLWGPQHQTVSPDGRSLTLWMDRSSGSGFKSARAYRNGYFGASVRVQPGYTAGVNTAFYLSNSEEYPGHHDEIDMELLGTVPGEPYTLQTNVYVRGSGDGTIVGREMRFHLWFDPTADFHHYAIIWNPDQILFLVDDVPIRRYERKTEATFPDREMWAYGSIWDASDWATDGGRYRADYRYQPFVSRFADLKIGGCAADAPAGGCRPVPASPSGSAAALSPQQEAAMRWAQRNSMVYYYCLDSSRDHALYPEC

SEQ ID NO: 50335 - protein, 299 aa, Arabidopsis thaliana
  misc_feature: Useful for making plants with altered cell wall content and/or composition
MGNSLISLLSIFHLLVLWGSSVNAYWPPSPGYWPSSKVGSLNFYKGFRNLWGPQHQRMDQNALTIWLDRTSGSGFKSVKPFRSGYFGANIKLQPGYTAGVITSLYLSNNEAHPGFHDEVDIEFLGTTFGKPYTLQTNVYIRGSGDGKIIGREMKFRLWFDPTKDFHHYAILWSPREIIFLVDDIPIRRYPKKSASTFPLRPMWLYGSIWDASSWATEDGKYKADYKYQPFTAKYTNFKALGCTAYSSARCYPLSASPYRSGGLTRQQHQAMRWVQTHSMVYNYCKDYKRDHSLTPECWR

SEQ ID NO: 50336 - protein, 653 aa, Nicotiana tabacum
  misc_feature: Useful for making plants with modulated heat sensitivity
MAPAVGIDLGTTYSCVGIFREIGKCDIIANDQGNRTTPSFVGFTDTERLIGDAAKNQVAMNPQNTVFDAKRLIGRKFADPEVQADMKHFPFKIVDKGGKPNIEVEFKGETKTFTPEEISAMILTKMRETAESYLGETVTNAVVTVPAYFNDSQRQATKDAGLIAGLNVLRIINEPTAAAIAYGLDKKVEGERNVLIFDLGGGTFDVSLLTIEEGIFEVKSTAGDTHLGGEDFDNRLVNHFVNEFKRKHKKDLSTNVRALRRLRTACERAKRTLSSSAQTSIEIDSLFEGIDFYTSITRARFEELCQDLFRSTIQPVDRVLTDAKIDKSLVHEIVLVGGSTRILRVQKLITDYFNGKEPNKSINPDEAVAYGAAVQAAILSGDTSSKATNEILLLDVAPLSLGIETAGGMMTKLIPRNTTIPTKKSEVFSTFSDNQPGVLIQVYEGERQRTKDNNLMGKFELTGIPPAPRGVPQIEVTFDLDANGIMNVSAVEKGTGKSNKIVITNDKGRLSKEEIERMLSDAEKYKEEDEAEGKRVAAKNGLESYAYSLRNTLSDPKVEEKIEASDKETLTAEIDKVVQWLDDNQQATREEYEEHQKELEGKANPIMMKFYGAGGEGAPGGMPGGPGGFPGAGGPGGAPGAGGDDGPTVEEVD

SEQ ID NO: 50337 - protein, 532 aa, Panicum virgatum; identical to SEQ ID NO: 11440
  misc_feature: Useful for making plants with altered carbohydrate content

SEQ ID NO: 50338 - protein, 400 aa, Arabidopsis thaliana
  misc_feature: Useful for making plants with altered cell wall content and/or composition
MTRQVIAEAKESFDNQLKIQKLKDTIFAVNEQLTNAKKQGAFSSLIAAKSIPKGLHCLAMRLMEERIAHPEKYTDEGKDRPRELEDPNLYHYAIFSDNVIAASVVVNSAVKNAKEPWKHVFHVVTDKMNLGAMQVMFKLKEYKGAHVEVKAVEDYTFLNSSYVPVLKQLESANLQKFYFENKLENATKDTTNMKFRNPKYLSILNHLRFYLPEMYPKLHRILFLDDDVVVQKDLTGLWEIDMDGKVNGAVETCFGSFHRYAQYMNFSHPLIKEKFNPKACAWAYGMNFFDLDAWRREKCTEEYHYWQNLNENRALWKLGTLPPGLITFYSTTKPLDKSWHVLGLGYNPSISMDEIRNAAVVHFNGNMKPWLDIAMNQFRPLWTKHVDYDLEFVQACNFGL

SEQ ID NO: 50339 - protein, 437 aa, Panicum virgatum; identical to SEQ ID NO: 3224
  misc_feature: Useful for making plants with altered carbohydrate content

SEQ ID NO: 50340 - protein, 397 aa, Arabidopsis thaliana
  misc_feature: Useful for making plants with modulated nitrogen use efficiency
MDFNAGVPMSSLSPLMNQDAMWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 50341 - protein, 397 aa, Arabidopsis thaliana; identical to SEQ ID NO: 9406
  misc_feature: Useful for making plants with modulated low light sensitivity

SEQ ID NO: 50342 - protein, 404 aa, Arabidopsis thaliana
  misc_feature: Useful for making plants with altered alkaloid content
  misc_feature: Useful for making plants with altered lignin content
  misc_feature: Useful for making plants with altered terpenoid content
  misc_feature: Useful for making plants with modulated flowering time
MRTPMSDTQHVQSSLVSIRSSDKIEDAFRKMKVNETGVEELNPYPDRPGERDCQFYLRTGLCGYGSSCRYNHPTHLPQDVAYYKEELPERIGQPDCEYFLKTGACKYGPTCKYHHPKDRNGAQPVMFNVIGLPMRLGEKPCPYYLRTGTCRFGVACKFHHPQPDNGHSTAYGMSSFPAADLRYASGLTMMSTYGTLPRPQVPQSYVPILVSPSQGFLPPQGWAPYMAASNSMYNVKNQPYYSGSSASMAMAVALNRGLSESSDQPECRFFMNTGTCKYGDDCKYSHPGVRISQPPPSLINPLVLPARPGQPACGNFRSYGFCKFGPNCKFDHPMLPYPGLTMATSLPTPFASPVTTHQRISPTPNRSDSKSLSNGKPDVKKESSETEKPDNGEVQDLSEDASSP

SEQ ID NO: 50343 - protein, 192 aa, Panicum virgatum; identical to SEQ ID NO: 6058
  misc_feature: Useful for making plants with altered carbohydrate content

SEQ ID NO: 50344 - protein, 159 aa, Arabidopsis thaliana
  misc_feature: Useful for making plants with altered sterol content
  misc_feature: Useful for making plants with altered terpenoid content
MKRIVRISFTDMEATDSSSSEDESPPSSRRRGKKLVKEIVIDHSDPPEVGKTRFKIRIPASLLAARNTTANKKKFRGVRQRPWGKWAAEIRCGRVKGRPERIWLGTFETAEEAALAYDNAAIQLIGPDAPTNFGRPDVDSAVVKKQDSDASGGASEEVV

SEQ ID NO: 50345 - protein, 430 aa, Arabidopsis thaliana; identical to SEQ ID NO: 9230
  misc_feature: Useful for biocontainment applications

SEQ ID NO: 50346 - protein, 606 aa, Arabidopsis thaliana
  misc_feature: Useful for making plants with altered cell wall content and/or composition
MQQDNRKKNNLEMEFFSDYGDANRFKVQEVIGKGSYGVVCSAIDTLTGEKVAIKKIHDIFEHISDAARILREIKLLRLLRHPDIVEIKHIMLPPSRREFKDIYVVFELMESDLHQVIKANDDLTREHYQFFLYQLLRALKYIHTANVYHRDLKPKNILANANCKLKICDFGLARVAFNDTPTTIFWTDYVATRWYRAPELCGSFYSKYTPAIDIWSIGCIFAEVLMGKPLFPGKNVVHQLDLMTDLLGTPSLDTISRVRNEKARRYLTSMRKKPPIPFAQKFPNADPLSLKLLERLLAFDPKDRPTAEEALADPYFKGLAKVEREPSCQPITKMEFEFERRKVTKEDIRELISREILEYHPQLLKDHMNGADKASFLYPSAVDQFRRQFAHLEENSGKTGPVAPLERKHASLPRSTVIHSTAVARGGQPKLMNNTNTLNPETTQNIPFNHATIQAQQRNLSAAKPSTFMGPVAPFDNGRISRDAYDPRSFIRSTNLPFSQQSAATVAMGKQQERRTTMEPEKQARQISQYNRYAPDVAINIDNNPFIMARTGMNKAENISDRIIIDTNLLQATAGIGVAAAAAAAAPGGSAHRKVGAVRYGMSKMY

SEQ ID NO: 50347 - protein, 433 aa, Zea mays; identical to SEQ ID NO: 9389
  misc_feature: Useful for making plants with altered alkaloid content

SEQ ID NO: 50348 - protein, 452 aa, Glycine max; identical to SEQ ID NO: 9658
  misc_feature: Useful for making plants with modulated biomass

SEQ ID NO: 50349 - protein, 612 aa, Arabidopsis thaliana
  misc_feature: Useful for making plants with modulated light quality response
  misc_feature: Useful for making plants with modulated light quality sensitivity
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 50350 - protein, 681 aa, Arabidopsis thaliana
  misc_feature: Useful for making plants with modulated light quality response
  misc_feature: Useful for making plants with modulated low light sensitivity
  misc_feature: Useful for making plants with modulated nitrogen use efficiency
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTG

SEQ ID NO: 50351 - protein, 708 aa, Panicum virgatum
  misc_feature: Useful for making plants with altered carbohydrate content
MLISLASSLRSSLLPIQFQPHPLPELHRLISWWLQTMCIQGHAVALVVPAGLLLTLTLLVAGIPWEACNSTITGNYTANSTYGGNLRLVAAALPGNVSTSPTLFAKAVIGTAPDIVYALGQCSGDQSAAACHDCINASFAAAQKLCPFNKGAAVFYDTCFVGFSGRDFLASTTNSDDQEVQLYNGQNITSDGADRFNATAYELLNAMAEHMATTNSEKFLTGTIGFDDTTYPNIYGMASCTSDLTPGQCRGCLDAAIAEMPRVFIPNTKGARIAGLRCIVRYEVYRFYNGSTMLQLPGTHAGRIGSKKSNDTGKILAIVLPIVVAIAASLAMCVFCRRRTKSKSKRSLSFTSHMEDIECIESLVIDLPTLRLATNNFAEDKKLGEGGFGAVYKGSLPNGQEIAVKRLSQNSRQGIGELRNELVLIAKLQHKNLVRLVGVCLEEEEKLLVYEYMPNTSLDTFLFDSEKRKELDWGKRFTIINGITRGLQYLHEDSQLKIVHRDLKASNILLDTAMNPKISDFGLARLFGEDQSQDTTRRVVGTYGYMAPEYALRGQYSIKSDIYSFGVLILEIITGRRNSDSYNSDQSVDLPSLVWEHWTTRSITDMVDPYFRSDSSWDEILRCIHIGLSCVQEDPVDRPTISAISIMLDSGTVPSQPPSRPAFYVEMSGNVDSGMYSSQSYPGFVNKSTAKSTVVSPNELSVTDPEPR

SEQ ID NO: 50352 - protein, 573 aa, Nicotiana tabacum; identical to SEQ ID NO: 9677
  misc_feature: Useful for making plants with modulated drought sensitivity
  misc_feature: Useful for making plants with modulated heat sensitivity

SEQ ID NO: 50353 - protein, 567 aa, Panicum virgatum; identical to SEQ ID NO: 11757
  misc_feature: Useful for making plants with altered carbohydrate content

SEQ ID NO: 50354 - protein, 554 aa, Arabidopsis thaliana
  misc_feature: Useful for making plants with altered cell wall content and/or composition
MDHKILLTPPKSLYTKCIITIIYVVSISHLNAHFITSCKQTPYPSVCDHHMSNSPLKTLDDQTDGFTFHDLVVSSTMDQAVQLHRLVSSLKQHHSLHKHATSALFDCLELYEDTIDQLNHSRRSYGQYSSPHDRQTSLSAAIANQDTCRNGFRDFKLTSSYSKYFPVQFHRNLTKSISNSLAVTKAAAEAEAVAEKYPSTGFTKFSKQRSSAGGGSHRRLLLFSDEKFPSWFPLSDRKLLEDSKTTAKADLVVAKDGSGHYTSIQQAVNAAAKLPRRNQRLVIYVKAGVYRENVVIKKSIKNVMVIGDGIDSTIVTGNRNVQDGTTTFRSATFAVSGNGFIAQGITFENTAGPEKHQAVALRSSSDFSVFYACSFKGYQDTLYLHSSRQFLRNCNIYGTVDFIFGDATAILQNCNIYARKPMSGQKNTITAQSRKEPDETTGFVIQSSTVATASETYLGRPWRSHSRTVFMKCNLGALVSPAGWLPWSGSFALSTLYYGEYGNTGAGASVSGRVKWPGYHVIKTVTEAEKFTVENFLDGNYWITATGVPVNDGL

SEQ ID NO: 50355 - protein, 598 aa, Arabidopsis thaliana
  misc_feature: Useful for making plants with modulated time to senescence
MGYERLGPSGATGSVTTSTTTAPILNQVSTSEQPENNNRRSKKKLVVSSIVLAISLILAAAIFAGVRSRLKLNQSVPGLARKPSQAISKACELTRFPELCVDSLMDFPGSLAASSSKDLIHVTVNMTLHHFSHALYSSASLSFVDMPPRARSAYDSCVELLDDSVDALSRALSSVVSSSAKPQDVTTWLSAALTNHDTCTEGFDGVDDGGVKDHMTAALQNLSELVSNCLAIFSASHDGDDFAGVPIQNRRLLGVEEREEKFPRWMRPKEREILEMPVSQIQADIIVSKDGNGTCKTISEAIKKAPQNSTRRIIIYVKAGRYEENNLKVGRKKINLMFVGDGKGKTVISGGKSIFDNITTFHTASFAATGAGFIARDITFENWAGPAKHQAVALRIGADHAVIYRCNIIGYQDTLYVHSNRQFFRECDIYGTVDFIFGNAAVVLQNCSIYARKPMDFQKNTITAQNRKDPNQNTGISIHASRVLAASDLQATNGSTQTYLGRPWKLFSRTVYMMSYIGGHVHTRGWLEWNTTFALDTLYYGEYLNSGPGSGLGQRVSWPGYRVINSTAEANRFTVAEFIYGSSWLPSTGVSFLAGLSI

SEQ ID NO: 50356 - protein, 242 aa, Arabidopsis thaliana; identical to SEQ ID NO: 9719
  misc_feature: Useful for making plants with altered lignin content

SEQ ID NO: 50357 - protein, 517 aa, Arabidopsis thaliana
  misc_feature: Useful for making plants with modulated nitrogen use efficiency
MAMAMALRRLSSSIDKPIRPLIRSTSCYMSSLPSEAVDEKERSRVTWPKQLNAPLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAANVIPSPFDYADVVTTTTHKSLRGPRGAMIFFRKGVKEINKQGKEVLYDFEDKINQAVFPGLQGGPHNHTITGLAVALKQATTSEYKAYQEQVLSNSAKFAQTLMERGYELVSGGTDNHLVLVNLKPKGIDGSRVEKVLEAVHIASNKNTVPGDVSAMVPGGIRMGTPALTSRGFVEEDFAKVAEYFDKAVTIALKVKSEAQGTKLKDFVSAMESSSTIQSEIAKLRHEVEEFAKQFPTIGFEKETMKYKN

SEQ ID NO: 50358 - protein, 478 aa, Arabidopsis thaliana
  misc_feature: Useful for making plants with modulated biomass
MNRLFSLFSIALIAFLCLHHHVLASSSSDFEGFDAEDDDVSEDSTELHHSLRPPLLTQSESTVLDLDPSPDSDSTPASKSDPPTQTVKPSSSISFDYWDEDEFEGLPEDEKSTESPVFSDDASSPADPQTPDLESASETPDTDIPKKMQSYTVEIVCVSILIGYAINYFTGKRENENLALAWASKFGLKDTIFEKNFSLLGVGEGEDSPLLLKEATNVFKFYASGRRYCHGLLATLELKSRHDLISRLFNSVVPCKDEISFEVYMNDEAMDHIVFAMARKKAAKTMHKELGDLQRFGGMVPSPGGRKWVTEELAVVSESKEVAGDMITDVVLDQVFGDKSFEKFGKYFISMHFSDQHPGKHRKMLLFKFALPDIKHMDDMVRLIALIPYYIDLIGRYKLSSQARNKTDGARQKAAQEAYKELENVRQEALQRKKAEKKKILEEAQAKLSSEALRKKEAKERARQMKKSMPKVKMSRGH

SEQ ID NO: 50359 - protein, 534 aa, Arabidopsis thaliana
  misc_feature: Useful for making plants with altered cell wall content and/or composition
MAIKLIALVITLCVASWDVAQGRSLRFSTTPLNRYSFPPHFDFGVASSAYQYEGAVEEGGRSLSIWDNFTHAFPERTNMDNGDVAVDFYHRYKEDIKLIKEMNMDSFRFSLSWSRILPSGKLSDGVNKEGVQFYKNLIDELIENGIKPFVTIYHWDIPQALDDEYGSFLSPRIIDDFRNYARFCFQEFGDKVSMWTTFNEPYVYSVSGYDAGNKAMGRCSKWVNSLCIAGDSGTEPYLVSHHLLLAHAAAVEEFRKCDKISQDSKIGIVLSPYWFEPYDSASNADKEAVERALAFNIGWHLSPLVFGDYPETIKISAGNRLPSFTKEQSMMVKNSFDFIGVNYYTARFVAHDLNVDISRPRFMTDQHLQYKLTNRTGDTISLESDGTKILWSYPEGLRKILNYIKNKYNNPTIYITENGFDDYENGTVTREEILEDTKRIEYHQKHLQELQKAITEDGCDVKGYFTWSLLDNFEWEHGYAVRFGLYYVDYKNGLQRHAKHSAMWFKHFLERSGKPMPMDLFKSVKRWWSTLQMI

SEQ ID NO: 50360 - protein, 345 aa, Arabidopsis thaliana
  misc_feature: Useful for making plants with modulated biomass
  misc_feature: Useful for making plants with modulated flowering time
MVRFEKVHLVLGLALVLTLVGAPTKAQGPVCGAGLPDKFSRLNFPEGFIWGTATAAFQVEGAVNEGCRGPSMWDTFTKKFPHRCENHNADVAVDFYHRYKEDIQLMKDLNTDAFRLSIAWPRIFPHGRMSKGISKVGVQFYHDLIDELLKNNIIPLVTVFHWDTPQDLEDEYGGFLSGRIVQDFTEYANFTFHEYGHKVKHWITFNEPWVFSRAGYDNGKKAPGRCSPYIPGYGQHCQDGRSGYEAYQVSHNLLLSHAYAVDAFRKCKQCAGGKIGIAHSPAWFEPQDLEHVGGSIERVLDFILGWHLAPTTYGDYPQSMKDRVGHRLPKFTEAEKKLLKGSTDY

SEQ ID NO: 50361 - protein, 491 aa, Hordeum vulgare subsp. vulgare
  misc_feature: Useful for making plants with modulated biotic stress sensitivity
MAGGGGKAKPLEFTPTWIVALVCSVMVIISLLFERLLHRLGKRLIRSRKKPLYEALLKVKEELMLLGFISLLLTVFQGPMGKVCVSPITMLHLQPCKPPPDETDHLGDAVFAGVLGGGRRLLAGGASSDEYCLKKDKVPLLSSEAIHQLHIFIFVLAVTHFLLSAITVLLGMAQTRNWRHWETKIQEKDDSAPQMIKHVREFKFIQDHFKDHRKRSRIFAWMRSFFKQFYGSITEEDYTTMRLGFIMKHCKGTPKFNFYSYMIRALEVDFKKVVGISWYLWAMLMIFLLLNVEGWYVYIWITLVPFIMLLVVASKMEHIITELAYEVAHKHTAIRGDLVVAPSDDFFWFHRPKLVLLLIHIVLFQNAFQIAFFFWLLVTYGFKSCIMGKPAYVITRVVISVICQILCGYSTLPLYAIVSHMGNSFKKTIFDENVTEGLVNWAEKARRGTRTPNKITTDASSSPIDEANGGIVQMTNTRANSSVDQGTARLI

SEQ ID NO: 50362 - protein, 247 aa, Arabidopsis thaliana
  misc_feature: Useful for making plants with altered cell wall content and/or composition
MSMMAGIQGQILEVTVVGCQKLKDTEWFSRQDPYVVLEYGGRSHRTRTCTDGGKNAVFQEKFIFTLIEGLRDLKVAVWNSNTLSTDDFIGNATIQLQKVLSQEYDDCTWTLQSKTGRFAGEVQLLLHYAGAKKHNYGSAPSAPYAPHVPQYSAPPSASPYSTAPPYSGPSLYPQVQQYPQPSGYPPASGYPPQPSAYPPPSTSGYPPIPSAYPPPPPSSAYPPQPYPPQPSYYPQGPYPGQYPPPPY

SEQ ID NO: 50363 - protein, 1049 aa, Arabidopsis thaliana
  misc_feature: Useful for making plants with altered cell wall content and/or composition
  misc_feature: Useful for making plants with modulated biomass
MEPNTMASFDDEHRHSSFSAKICKVCGDEVKDDDNGQTFVACHVCVYPVCKPCYEYERSNGNKCCPQCNTLYKRHKGSPKIAGDEENNGPDDSDDELNIKYRQDGSSIHQNFAYGSENGDYNSKQQWRPNGRAFSSTGSVLGKDFEAERDGYTDAEWKERVDKWKARQEKRGLVTKGEQTNEDKEDDEEEYLDAEARQPLWRKVPISSSKISPYRIVIVLRLVILVFFFRFRILTPAKDAYPLWLISVICEIWFALSWILDQFPKWFPINRETYLDRLSMRFERDGEKNKLAPVDVFVSTVDPLKEPPIITANTILSILAVDYPVNKVSCYVSDDGASMLLFDTLSETSEFARRWVPFCKKYNVEPRAPEFYFSEKIDYLKDKVQTTFVKDRRAMKREYEEFKVRINALVAKAQKKPEEGWVMQDGTPWPGNNTRDHPGMIQVYLGKEGAFDIDGNELPRLVYVSREKRPGYAHHKKAGAMNAMVRVSAVLTNAPFMLNLDCDHYINNSKAIRESMCFLMDPQLGKKLCYVQFPQRFDGIDLNDRYANRNIVFFDINMRGLDGIQGPVYVGTGCVFNRPALYGYEPPVSEKRKKMTCDCWPSWICCCCGGGNRNHKSDSSKKKSGIKSLFSKLKKKTKKKSDDKTMSSYSRKRSSTEAIFDLEDIEEGLEGYDELEKSSLMSQKNFEKRFGMSPVFIASTLMENGGLPEATNTSSLIKEAIHVISCGYEEKTEWGKEIGWIYGSVTEDILTGFRMHCRGWKSVYCMPKRPAFKGSAPINLSDRLHQVLRWALGSVEIFFSRHCPLWYAWGGKLKILERLAYINTIVYPFTSIPLLAYCTIPAVCLLTGKFIIPTINNFASIWFLALFLSIIATAILELRWSGVSINDLWRNEQFWVIGGVSAHLFAVFQGLLKVLFGVDTNFTVTSKGASDEADEFGDLYLFKWTTLLIPPTTLIILNMVGVVAGVSDAINNGYGSWGPLFGKLFFAFWVIVHLYPFLKGLMGRQNRTPTIVVLWSILLASIFSLVWVRIDPFLPKQTGPLLKQCGVDC

SEQ ID NO: 50364 - protein, 368 aa, Arabidopsis thaliana; identical to SEQ ID NO: 9521
  misc_feature: Useful for making plants with modulated biomass
  misc_feature (294)..(294): Xaa is any aa, unknown, or other

SEQ ID NO: 50365 - protein, 380 aa, Arabidopsis thaliana; identical to SEQ ID NO: 9591
  misc_feature: Useful for making plants with modulated biomass

SEQ ID NO: 50366 - protein, 411 aa, Oryza sativa subsp. japonica
  misc_feature: Useful for making plants with modulated water use efficiency
MASVGVVRSSLGFQNETSTSGDADRLPNEMSNMSIRDDNKDIDDIVVNGNGTEPGHVIVTSIDGRNGQAKQTISYMAERVVGHGSFGTVFQAKCLETGETVAIKKVLQDKRYKNRELQTMRVLDHPNVVSLKHCFFSKTEKEELYLNLVLEYVPETAHRVIKHYNKMNQRMPLIYAKLYMYQICRALAYIHNTIGVCHRDIKPQNLLVNPHTHQLKLCDFGSAKVLVKGEPNISYICSRYYRAPELIFGATEYTTAIDVWSAGCVLAELLLGQPLFPGDSGVDQLVEIIKVLGTPTREEIKCMNPNYTEFKFPQIKAHPWHKIFHKRMPAEAVDLVSRLLQYSPYLRSTAPEALIHPFFDELRDPNTRLPNGRFLPPLFNFKPHELKGMPMEFLVKLIPEHARKQCAFVGW

SEQ ID NO: 50367 - protein, 425 aa, Arabidopsis thaliana
  misc_feature: Useful for making plants with altered cell wall content and/or composition
MYERYTTPIKCDSTRVSMSVKEGQSIVFSYEVSFEESDIKWPSRWDAYLKMEGSKVHWFSILNSLMVITFLAGIVLVIFLRTVRRDLTRYEELDKEAQAQMNEELSGWKLVVGDVFRAPSNASLLCVMVGDGVQILGMAVVTILFAALGFMSPASRGTLITGMLFFYMILGIAAGYVSVRLWRTIGCGEHRGWMSVAWKAACFFPGIAFLILTTLNFLLWGSHSTGAIPFSLFVILLLLWFCISVPLTLIGGYFGAKAPHIEFPVRTNQIPREIPAQKYPSWLLVLGAGTLPFGTLFIELFFIMSSIWMGRVYYVFGFLFVVLILLVVVCAEVSLVLTYMHLCVEDYKWWWKSFFASGSVAIYIFIYSINYLVFDLKSLSGPVSATLYLGYSLFMVLAIMLATGTVGFLSSFWFVHYLFSSVKLD

SEQ ID NO: 50368 - protein, 427 aa, Arabidopsis thaliana
  misc_feature: Useful for biocontainment applications
  misc_feature: Useful for making plants with modulated biomass
  misc_feature: Useful for making plants with modulated cold sensitivity
MGDARDNEAYEEELLDYEEEDEKVPDSGNKVNGEAVKKGYVGIHSSGFRDFLLKPELLRAIVDSGFEHPSEVQHECIPQAILGMDVICQAKSGMGKTAVFVLSTLQQIEPSPGQVSALVLCHTRELAYQICNEFVRFSTYLPDTKVSVFYGGVNIKIHKDLLKNECPHIVVGTPGRVLALAREKDLSLKNVRHFILDECDKMLESLDMRRDVQEIFKMTPHDKQVMMFSATLSKEIRPVCKKFMQDPMEIYVDDEAKLTLHGLVQHYIKLSEMEKNRKLNDLLDALDFNQVVIFVKSVSRAAELNKLLVECNFPSICIHSGMSQEERLTRYKSFKEGHKRILVATDLVGRGIDIERVNIVINYDMPDSADTYLHRVGRAGRFGTKGLAITFVASASDSEVLNQVQERFEVDIKELPEQIDTSTYMPS

SEQ ID NO: 50369 - protein, 587 aa, Arabidopsis thaliana
  misc_feature: Useful for making plants with altered cell wall content and/or composition
MGYDRLGPSGPSNPNQKDPATSLPELQKKTKTKLILFTLAVLVVGVVCFGIFAGIRAVDSGKTEPKLTRKPTQAISRTCSKSLYPNLCIDTLLDFPGSLTADENELIHISFNATLQKFSKALYTSSTITYTQMPPRVRSAYDSCLELLDDSVDALTRALSSVVVVSGDESHSDVMTWLSSAMTNHDTCTDGFDEIEGQGGEVKDQVIGAVKDLSEMVSNCLAIFAGKVKDLSGVPVVNNRKLLGTEETEELPNWLKREDRELLGTPTSAIQADITVSKDGSGTFKTIAEAIKKAPEHSSRRFVIYVKAGRYEEENLKVGRKKTNLMFIGDGKGKTVITGGKSIADDLTTFHTATFAATGAGFIVRDMTFENYAGPAKHQAVALRVGGDHAVVYRCNIIGYQDALYVHSNRQFFRECEIYGTVDFIFGNAAVILQSCNIYARKPMAQQKITITAQNRKDPNQNTGISIHACKLLATPDLEASKGSYPTYLGRPWKLYSRVVYMMSDMGDHIDPRGWLEWNGPFALDSLYYGEYMNKGLGSGIGQRVKWPGYHVITSTVEASKFTVAQFISGSSWLPSTGVSFFSGLSQ

SEQ ID NO: 50370 - protein, 424 aa, Arabidopsis thaliana
  misc_feature: Useful for making plants with altered lignin content
MRTLLPSHTPATVTTAARRRHVIHCAGKRSDSFSINSSSSDWQSSCAILSSKVNSQEQSESLSSNSNGSSSYHVSAVNGHNNGAGVSDLNLVPFNNNQSIQSKKPLSISDLSPAPMHGSNLRVAYQGVPGAYSEAAAGKAYPNCQAIPCDQFEVAFQAVELWIADRAVLPVENSLGGSIHRNYDLLLRHRLHIVGEVQLPVHHCLMALPGVRKEFLTRVISHPQGLAQCEHTLTKLGLNVAREAVDDTAGAAEFIAANNIRDTAAIASARAAEIYGLEILEDGIQDDASNVTRFVMLAREPIIPRTDRPFKTSIVFAHEKGTCVLFKVLSAFAFRNISLTKIESRPNHNVPIRLVDEANVGTAKHFEYMFYIDFEASMAESRAQNALSEVQEFTSFLRVLGSYPMDMTSWSPSSSSSSSSTFSL

SEQ ID NO: 50371 - protein, 338 aa, Arabidopsis thaliana; identical to SEQ ID NO: 9676
  misc_feature: Useful for making plants with altered tocopherol content

SEQ ID NO: 50372 - protein, 79 aa, Arabidopsis thaliana; identical to SEQ ID NO: 9413
  misc_feature: Useful for making plants with modulated biomass

SEQ ID NO: 50373 - protein, 231 aa, Zea mays
  misc_feature: Useful for making plants with altered alkaloid content
MAPALSFPIIDMGLLAGEERPAAMERLQDACENWGFFEILNHGISTELMDEVEKLTKEHYKRVREQRFLEFASKTLGDGRVKIPIQKDGEIPIPYKPDVDVEKIKFHHFSFEETTATLHLKLENKNDFDLGLNLLEYEMWLGDDSIASAELTQTAKIEKQGITRMQVPFSFRPKDFGSAVWDMIRGRGTGYTIKGKIDVDTPFGNMKLPISKEGGTTHLKKEDDDDDDDDN

SEQ ID NO: 50374 - protein, 292 aa, Panicum virgatum; identical to SEQ ID NO: 6802
  misc_feature: Useful for making plants with altered carbohydrate content

SEQ ID NO: 50375 - protein, 259 aa, Arabidopsis thaliana
  misc_feature: Useful for making plants with altered cell wall content and/or composition
MASSQRYFALLALFAVSLKFCYCQNETIDVAGSGTAGVTWYGEPFGAGSTGGACGYGSAVANPPLYAMVSAGGPSLFNNGKGCGTCYQVVCIGHPACSGSPITVTITDECPGGPCASEPVHIDLSGKAMGALAKPGQADQLRSAGVIRVNYKRAACLYRGTNIVFRMDAGANPYYISFVVEYENGDGDLSNVEIQPAGGSFISMQEMRSAVWKVNSGSALRGPFNIRLTSGESHKVIVAYNVIPANWKPDESYRSIVNF

SEQ ID NO: 50376 - protein, 313 aa, Panicum virgatum; identical to SEQ ID NO: 11869
  misc_feature: Useful for making plants with altered carbohydrate content

SEQ ID NO: 50377 - protein, 326 aa, Arabidopsis thaliana
  misc_feature: Useful for making plants with altered cell wall content and/or composition
MNCLIAIALSVSFFLVGIVGPIQAQLQMNFYANSCPNAEKIVQDFVSNHVSNAPSLAAALIRMHFHDCFVRGCDGSVLINSTSGNAERDATPNLTVRGFGFIDAIKSVLEAQCPGIVSCADIIALASRDAVVFTGGPNWSVPTGRRDGRISNAAEALANIPPPTSNITNLQTLFANQGLDLKDLVLLSGAHTIGVSHCSSFTNRLYNFTGRGGQDPALDSEYAANLKSRKCPSLNDNKTIVEMDPGSRKTFDLSYYQLVLKRRGLFQSDSALTTNPTTLSNINRILTGSVGSFFSEFAKSMEKMGRINVKTGSAGVVRRQCSVANS

SEQ ID NO: 50378 - protein, 73 aa, Arabidopsis thaliana
  misc_feature: Useful for making plants with modulated biomass
MAAEFDGKIESKGLNPGLIVLLVIGGLLLTFLVGNFILYTYAQKNLPPRKKKPVSKKKMKKEKMKQGVQVPGE

SEQ ID NO: 50379 - protein, 327 aa, Panicum virgatum; identical to SEQ ID NO: 5996
  misc_feature: Useful for making plants with altered carbohydrate content

SEQ ID NO: 50380 - protein, 254 aa, Zea mays; identical to SEQ ID NO: 9518
  misc_feature: Useful for making plants with modulated nitrogen use efficiency

SEQ ID NO: 50381 - protein, 138 aa, Zea mays
  misc_feature: Useful for making plants with altered lignin content
  misc_feature (81)..(81): Xaa is any aa, unknown, or other
MEGGETTLSGFGGAGAPGVDTKVLHAFQTSFVQVQTLLDQNRLLINEINHNHESKVPGDLSRKRGPHQGAQQQHPPRRRPXRRPLLALRRGRRRRRPRRVRGRVRGHRPPPGGRRPQEDQVRPRLICCQAFLLRREKE

SEQ ID NO: 50382 - protein, 238 aa, Arabidopsis thaliana
  misc_feature: Useful for making plants with modulated salt sensitivity
MAVSSLSIRCGGFSPTISHKTEILCPNPSLKACCLLSSGGKADSSESTYQKGSGNNWKRRQALVGVGTLVATSIPATLLLAEEIPKSYSPFVDREDGYSYYYPSDWREFDFRAHDSAFKDRYLQLQNVRVRFIPTEKNDIHEVGPMEEVVYDLVKHKFAAPNQVATIYDMKERVEDGKNYYTFEYGLRTPIYATTSFATVAVGNNRYYTLIVGANERRWRKVKKQLQVVADSLKILQI

SEQ ID NO: 50383 - protein, 98 aa, Arabidopsis thaliana; identical to SEQ ID NO: 9416
  misc_feature: Useful for biocontainment applications
  misc_feature: Useful for making plants with modulated biomass

SEQ ID NO: 50384 - protein, 151 aa, Arabidopsis thaliana; identical to SEQ ID NO: 9202
  misc_feature: Useful for making plants with modulated nitrogen use efficiency

SEQ ID NO: 50385 - protein, 286 aa, Arabidopsis thaliana
  misc_feature: Useful for making plants with altered cell wall content and/or composition
MAMISYSTIVVALLASFMICSVSANFQRDVEITWGDGRGQITNNGDLLTLSLDKASGSGFQSKNEYLFGKIDMQIKLVAGNSAGTVTAYYLKSPGSTWDEIDFEFLGNLSGDPYTLHTNVFTQGKGDREQQFKLWFDPTSDFHTYSILWNPQRIIFSVDGTPIREFKNMESQGTLFPKNQPMRMYSSLWNAEEWATRGGLVKTDWSKAPFTASYRGFNEEACVVINGQSSCPNVSGQGSTGSWLSQELDSTGQEQMRWVQNNYMIYNYCTDAKRFPQGLPRECLAA

SEQ ID NO: 50386 - protein, 287 aa, Panicum virgatum; identical to SEQ ID NO: 204
  misc_feature: Useful for making plants with altered carbohydrate content

SEQ ID NO: 50387 - protein, 63 aa, Arabidopsis thaliana
  misc_feature: Useful for making plants with modulated nitrogen use efficiency
MKKIEDNNTLVFIVDIRADKKKIKDAVKKMYDIQTKKVNTLIRYFKEYFSMKPCCEIDYVQYI

SEQ ID NO: 50388 - protein, 115 aa, Arabidopsis thaliana; identical to SEQ ID NO: 9735
  misc_feature: Useful for making plants with modulated biomass

SEQ ID NO: 50389 - protein, 126 aa, Panicum virgatum; identical to SEQ ID NO: 12026
  misc_feature: Useful for making plants with altered carbohydrate content

SEQ ID NO: 50390 - protein, 125 aa, Panicum virgatum
  misc_feature: Useful for making plants with altered carbohydrate content
  misc_feature (110)..(110): Xaa is any aa, unknown, or other
MAGLRMKLVAAAAVAAALVASAAAATEAPAPAPASDAAAAVPLAAASLAAAAFGYLFCIRRPFPVGPADIMIRSGVAVESVWGGCRWACVCTSSAAVGVVCERWLRASTXRSLWRRSCTHSVSGY

SEQ ID NO: 50391 - protein, 267 aa, Panicum virgatum; identical to SEQ ID NO: 23034
  misc_feature: Useful for making plants with altered carbohydrate content

SEQ ID NO: 50392 - protein, 584 aa, Panicum virgatum; identical to SEQ ID NO: 3756
  misc_feature: Useful for making plants with altered carbohydrate content

SEQ ID NO: 50393 - protein, 577 aa, Arabidopsis thaliana
  misc_feature: Useful for making plants with altered cell wall content and/or composition
MALQLLLAVFSCVLLLPQPAFGITRHYTLEIKMQNVTRLCHTKSLVSVNGQFPGPKLIAREGDQVLIKVVNQVPNNISLHWHGIRQLRSGWADGPAYITQCPIQTGQSYVYNYTIVGQRGTLWYHAHISWLRSTVYGPLIILPKRGVPYPFAKPHKEVPMIFGEWFNADTEAIIRQATQTGGGPNVSDAYTINGLPGPLYNCSAKDTFRLRVKPGKTYLLRLINAALNDELFFSIANHTVTVVEADAIYVKPFETETILIAPGQTTNVLLKTKSSYPSASFFMTARPYVTGQGTFDNSTVAGILEYEPPKQTKGAHSRTSIKNLQLFKPILPALNDTNFATKFSNKLRSLNSKNFPANVPLNVDRKFFFTVGLGTNPCNHKNNQTCQGPTNTTMFAASISNISFTMPTKALLQSHYSGQSHGVYSPKFPWSPIVPFNYTGTPPNNTMVSNGTNLMVLPYNTSVELVMQDTSILGAESHPLHLHGFNFFVVGQGFGNFDPNKDPRNFNLVDPIERNTVGVPSGGWAAIRFLADNPGVWFMHCHLEVHTSWGLRMAWLVLDGDKPDQKLLPPPADLPKC

SEQ ID NO: 50394 - protein, 557 aa, Arabidopsis thaliana
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: Useful for making plants with modulated low light sensitivity
MKMGFLFLFCYLLAFLGYSPVDAAVKKYQFDVQVKNISRICNAKPIVTVNGMFPGPTVYAREGDRVIINVTNHVQYNMSIHWHGLKQYRNGWADGPAYITQCPIQTGQSYLYDFNVTGQRGTLWWHAHILWLRATVYGAIVILPAPGKPYPFPQPYQESNIILGEWWNKDVETAVNQANQLGAPPPMSDAHTINGKPGPLFPCSEKHTFVIEAEAGKTYLLRIINAALNDELFFGIAGHNMTVVEIDAVYTKPFTTKAILLGPGQTTNVLVKTDRSPNRYFMAASPFMDAPVSVDNKTVTAILQYKGVPNTVLPILPKLPLPNDTSFALDYNGKLKSLNTPNFPALVPLKVDRRLFYTIGLGINACPTCVNGTNLAASINNITFIMPKTALLKAHYSNISGVFRTDFPDRPPKAFNYTGVPLTANLGTSTGTRLSRVKFNTTIELVLQDTNLLTVESHPFHLHGYNFFVVGTGVGNFDPKKDPAKFNLVDPPERNTVGVPTGGWAAIRFRADNPGVWFMHCHLEVHTMWGLKMAFVVENGETPELSVLPPPKDYPSC

SEQ ID NO: 50395 - protein, 281 aa, Arabidopsis thaliana
  misc_feature: Useful for making plants with altered cell wall content and/or composition
MLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 50396 - protein, 141 aa, Arabidopsis thaliana; identical to SEQ ID NO: 9232
  misc_feature: Useful for making plants with altered alkaloid content

SEQ ID NO: 50397 - protein, 127 aa, Zea mays; identical to SEQ ID NO: 9488
  misc_feature: Useful for making plants with altered lignin content
  misc_feature: Useful for making plants with altered terpenoid content

SEQ ID NO: 50398 - protein, 104 aa, Arabidopsis thaliana
  misc_feature: Useful for making plants with modulated nitrogen use efficiency
MKGAKSKAETRSTKLSVTKKPAKGAKGAAKDPNKPKRPSSAFFVFMEDFRVTYKEEHPKNKSVAAVGRSSQQQRMGLRNQLCSRKVSQVLSVCILLFFQSFEFE

SEQ ID NO: 50399 - protein, 102 aa, Arabidopsis thaliana; identical to SEQ ID NO: 9541
  misc_feature: Useful for making plants with modulated biomass

SEQ ID NO: 50400 - protein, 361 aa, Panicum virgatum; identical to SEQ ID NO: 1698
  misc_feature: Useful for making plants with altered carbohydrate content

SEQ ID NO: 50401 - protein, 363 aa, Arabidopsis thaliana
  misc_feature: Useful for making plants with altered cell wall content and/or composition
MGSTAETQLTPVQVTDDEAALFAMQLASASVLPMALKSALELDLLEIMAKNGSPMSPTEIASKLPTKNPEAPVMLDRILRLLTSYSVLTCSNRKLSGDGVERIYGLGPVCKYLTKNEDGVSIAALCLMNQDKVLMESWYHLKDAILDGGIPFNKAYGMSAFEYHGTDPRFNKVFNNGMSNHSTITMKKILETYKGFEGLTSLVDVGGGIGATLKMIVSKYPNLKGINFDLPHVIEDAPSHPGIEHVGGDMFVSVPKGDAIFMKWICHDWSDEHCVKFLKNCYESLPEDGKVILAECILPETPDSSLSTKQVVHVDCIMLAHNPGGKERTEKEFEALAKASGFKGIKVVCDAFGVNLIELLKKL

SEQ ID NO: 50402 - protein, 381 aa, Arabidopsis thaliana
  misc_feature: Useful for making plants with altered cell wall content and/or composition
  misc_feature: Useful for making plants with altered lignin content
MTNHLQDPLPTYPKPVLTKEEQEVDEKMVSLQAESIVNTVAFPMVLKAAFELGVIDTIAAAGNDTWLSPCEIACSLPTKPTNPEAPVLLDRMLSLLVSHSILKCRMIETGENGRTGKIERVYAAEPVCKYFLRDSDGTGSLVPLFMLLHTQVFFKTWTNLKDVILEGRDAFNSAHGMKIFEYINSDQPFAELFNRAMSEPSTMIMKKVLDVYRGFEDVNTLVDVGGGNGTVLGLVTSKYPHIKGVNFDLAQVLTQAPFYPGVEHVSGDMFVEVPKGDAVFMKWILHDWGDEDCIKILKNCWKSLPEKGKIIIVEFVTPKEPKGGDLSSNTVFAMDLLMLTQCSGGKERSLSQFENLAFASGFLRCEIICLAYSYSVIEFHK

SEQ ID NO: 50403 - protein, 203 aa, Arabidopsis thaliana
  misc_feature: Useful for making plants with modulated time to senescence
MKLFDYMGTDERFSKLFNQTGFTIAVVKKALEVYQGFKDVDVLVDVGGGVGNTLGVVTSKYPNIKGINFDLTCALAQAPSYPGVEHVAGDMFVDIPTGDAMILKRILHDWTDEDCVKILKNCWKSLPENGKVVVIELVTPDEAENGDINANIAFDMDMLMFTQCSGGKERSRAEFEALAAASGFTHCKFVCQAYHCWIIEFCK

SEQ ID NO: 50404 - protein, 196 aa, Panicum virgatum; identical to SEQ ID NO: 3370
  misc_feature: Useful for making plants with altered carbohydrate content

SEQ ID NO: 50405 - protein, 199 aa, Zea mays; identical to SEQ ID NO: 9377
  misc_feature: Useful for making plants with altered alkaloid content

SEQ ID NO: 50406 - protein, 275 aa, Arabidopsis thaliana
  misc_feature: Useful for making plants with modulated oxidative stress sensitivity
MALSLLSVFIFFHVFTNVVFAASNEESKALVSLPTPTLPSPSPATKPPSPALKPPTPSYKPPTLPTTPIKPPTTKPPVKPPTTSVTPVKPPVSTPPIKLPPVQPPTYKPPTPTVKPPSVQPPTYKPPTPTVKPPTTSPVKPPTTPPVQSPPVQPPTYKPPTSPVKPPTTTPPVKPPTTTPPVQPPTYNPPTTPVKPPTAPPVKPPTPPPVRTRIDCVPLCGTRCGQHSRKNVCMRACVTCCYRCKCVPPGTYGNKEKCGSCYANMKTRGGKSKCP

SEQ ID NO: 50407 - protein, 139 aa, Arabidopsis thaliana
  misc_feature: Useful for making plants with modulated nitrogen use efficiency
MIPQQWTPPCGSKCTNKYSAFTQLPWRVFCKKGCDADSDSWEDCVGDCSEICYKDPVLKDRPWTAVIDRSPGDAKYSEECFHACVAGCGYKFDVEAEIVNKVKPKRPPPPPPKPQPPPPPPRSQKPMQPPTEDVLATSA

SEQ ID NO: 50408 - protein, 1392 aa, Arabidopsis thaliana
  misc_feature: Useful for making plants with modulated flowering time
MAPGRKRGASKAKAKGQLVLGDLVLAKVKGFPAWPAKISRPEDWDRAPDPKKYFVQFFGTEEIAFVAPPDIQAFTSEAKSKLLARCQGKTVKYFAQAVEQICTAFEGLQNHKSNALGDEDSLDATEPGLTKAEIVDGTDHIVIESERTDNFNFRVDPCFPKLDENNGEERKAEIRKLDSSSFLESKVKTTSPVSESLEHSSFDPKIKKEDFDKGTDGSACNEHFGNGQKKLANGKRIKKEAGGSDRKGEDTVHRDKSNNSHVPGGRTASGNSDSKKSKGLLTEKTSSKVSADKHENSPGIKVGVSGKKRRLESEQGKLAPRVDESSRAAKKPRCESADNKVKCEIDDGSDSTGTVSDIKREIVLGLGARGGNFQYDKEAVAYTKRQRQTMEHATSPSFSGSRDKSGKGHLEQKDRSSPVRNVKAPAAQSLKKRRAVCIYDEDDDEDPKTPLHGKPAIVPQAASVLTDGPKRANVCHSTSTKAKISAGSTESTEVRKFPLRKHCEDASRVLPSNAENSTNSLPVVKPINELPPKDVKQILQSPKMSPQLVLTNKHVAGQHKVVKSSVKVSGVVMAKKPQSDSCKEAVAGSDKISSSQSQPANQRHKSASVGERLTVVSKAASRLNDSGSRDMSEDLSAAMLDLNREKGSATFTSAKTPDSAASMKDLIAAAQAKRKLAHTQNSIFGNLNPSFLSISDTQGRSHSPFMVQNASASAAISMPLVVQGHHQQGSSPSNHGHQSLSRNQIETDDNEERRLSSGHKSVGGSLSCSTEAAISRDAFEGMLETLSRTRESIGRATRLAIDCAKYGLASEVVELLIRKLESESHFHRKVDLFFLVDSITQHSHSQKGIAGASYVPTVQAALPRLLGAAAPPGTGASDNRRKCLKVLKLWLERKVFPESLLRRYIDDIRASGDDATGGFSLRRPSRSERAVDDPIREMEGMLVDEYGSNATFQLPGFFSSHNFEDDEEDDDLPTSQKEKSTSAGERVSALDDLEIHDTSSDKCHRVLEDVDHELEMEDVSGQRKDVAPSSFCENKTKEQSLDVMEPVAEKSTEFNPLPEDSPPLPQESPPPLPPLPPSPPPPSPPLPPSSLPPPPPAALFPPLPPPPSQPPPPPLSPPPSPPPPPPPPSQSLTTQLSIASHHQIPFQPGFPPPTYPLSHQTYPGSMQQDRSSIFTGDQIVQGPGNSSRGGLVEGAGKPEYFVQQSSSFSPAGVCSSREPSSFTSSRQLEFGNSDVLFNPEASSQNHRFQPSTPLSQRPMVRLPSAPSSHFSYPSHIQSQSQHSYTHPYPFPPQRDDARRYRNEEPWRIPSSGHSAENQNGAWIHGRNSHPGLPRVTDSFFRPPPERPPSGTMNYQPSAASNLQAVPAIPGHTAPQMLPSRPDIPTVNCWRPA

SEQ ID NO: 50409 - protein, 102 aa, Arabidopsis thaliana
  misc_feature: Useful for biocontainment applications
  misc_feature: Useful for making plants with modulated biomass
  misc_feature: Useful for making plants with modulated flowering time
MMKKRQMVIKQRSRNSNTSSSWTTTSSSSSSSEISNVRYVECQKNHAANIGGYAVDGCREFMAAGVEGTVDALRCAACGCHRNFHRKEVDTEVVCEYSPPNA

SEQ ID NO: 50410 - protein, 89 aa, Glycine max
  misc_feature: Useful for making plants with modulated low light sensitivity
MKKRQVVVKSVANTSSSVMRNIRYGECQKNHAANIGGYAVDGCREFMASTGEGAGGALTCAACGCHRNFHRREVNTEVVCEYSPPNSGR

SEQ ID NO: 50411 - protein, 244 aa, Arabidopsis thaliana; identical to SEQ ID NO: 9250
  misc_feature: Useful for biocontainment applications
  misc_feature: Useful for making plants with altered cell wall content and/or composition
  misc_feature: Useful for making plants with altered lignin content

SEQ ID NO: 50412 - protein, 248 aa, Arabidopsis thaliana
  misc_feature: Useful for making plants with modulated heat sensitivity
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 50413 - protein, 328 aa, Arabidopsis thaliana
  misc_feature: Useful for making plants with modulated biomass
  misc_feature: Useful for making plants with modulated flowering time
MEKALRNFTESTHSPDPNPLTKFFTEPTASPVSRNRKLSSKDTTVTIAGAGSSTTRYRGVRRRPWGRYAAEIRDPMSKERRWLGTFDTAEQAACAYDSAARAFRGAKARTNFTYPTAVIMPEPRFSFSNKKSSPSARCPLPSLPLDSSTQNFYGAPAAQRIYNTQSIFLRDASCSSRKTTPYNNSFNGSSSSYSASKTACVSYSENENNESFFPEESSDTGLLQEVVQEFLKKNRGVPPSPPTPPPVTSHHDNSGYFSNLTIYSENMVQETKETLSSKLDRYGNFQANDDGVRAVADGGLSLGSNEWGYQEMLMYGTQLGCTCRRSWG

SEQ ID NO: 50414 - protein, 161 aa, Arabidopsis thaliana
  misc_feature: Useful for making plants with modulated biotic stress sensitivity
MNFTGYSRFLIVFVALVGALVLPSKAQDSPQDYLRVHNQARGAVGVGPMQWDERVAAYARSYAEQLRGNCRLIHSGGPYGENLAWGSGDLSGVSAVNMWVSEKANYNYAANTCNGVCGHYTQVVWRKSVRLGCAKVRCNNGGTIISCNYDPRGNYVNEKPY

SEQ ID NO: 50415 - protein, 258 aa, Arabidopsis thaliana; identical to SEQ ID NO: 9277
  misc_feature: Useful for making plants with modulated biomass

SEQ ID NO: 50416 - protein, 67 aa, Arabidopsis thaliana; identical to SEQ ID NO: 9275
  misc_feature: Useful for making plants with modulated nitrogen use efficiency

SEQ ID NO: 50417 - protein, 67 aa, Arabidopsis thaliana
  misc_feature: Useful for making plants with modulated nitrogen use efficiency
MNQEAAETARESLELVFRMSNILETGLDRHTLSVLIALCDIGLNPEALATLVKELRRDSATTTTTVD

SEQ ID NO: 50418 - protein, 291 aa, Arabidopsis thaliana
  misc_feature: Useful for making plants with altered cell wall content and/or composition
MLRGRRLVFVGDSLNRNMWESLVCILKGSVKDETKVYEARGRHHFRGEAEYSFVFQDYNCTVEFFVSPFLVQEWEIVDKKGTKKETLRLDLVGKSSEQYKGADVIVFNTGHWWTHEKTSKGEDYYQEGSNVYHELAVLEAFRKALTTWGRWVEKNVNPAKSLVFFRGYSASHFSGGQWNSGGACDSETEPIKNDTYLTPYPSKMKVLEKVLRGMKTPVTYLNITRLTDYRKDGHPSVYRKQSLSEKEKKSPLLYQDCSHWCLPGVPDSWNEILYAELIVKLNQLSQTQRKT

SEQ ID NO: 50419 - protein, 277 aa, Arabidopsis thaliana
  misc_feature: Useful for making plants with modulated nitrogen use efficiency
MRDKTIMFVGDSLGRNQWESLICMISSSAPSINTHIIHEDPLSTFKILDYNVKVSFYRAPYLVDIDKINGKTTLKLDEISVDASNAWRTADVLLFNTGHWWSHTGSLRGWEQMETGGRYYGDMDRLVALRKGLGTWSSWVLRYNNSPLTRVFFLSVSPTHYNPNEWTSRSKTSTITQGGKSCYGQTTPFSGTTYPTSSYVNQKKVIDDVVKEMKSHVSLMDITMLSALRVDGHPSIYSGDLNPSLKRNPDRSSDCSHWCLPGLPDTWNQLFYAALLY

SEQ ID NO: 50420 - protein, 557 aa, Arabidopsis thaliana; identical to SEQ ID NO: 9675
  misc_feature: Useful for making plants with altered carbon content

SEQ ID NO: 50421 - protein, 570 aa, Arabidopsis thaliana; identical to SEQ ID NO: 9762
  misc_feature: Useful for making plants with altered carbon content
  misc_feature: Useful for making plants with altered nitrogen content
  misc_feature: Useful for making plants with modulated carbon-nitrogen partitioning

SEQ ID NO: 50422 - protein, 80 aa, Arabidopsis thaliana; identical to SEQ ID NO: 9184
  misc_feature: Useful for making plants with modulated cold sensitivity

SEQ ID NO: 50423 - protein, 110 aa, Arabidopsis thaliana; identical to SEQ ID NO: 9508
  misc_feature: Useful for making plants with modulated flowering time

SEQ ID NO: 50424 - protein, 100 aa, Arabidopsis thaliana
  misc_feature: Useful for making plants with modulated nitrogen use efficiency
MEFTAEQLSQYNGTDESKPIYVAIKGRVFDVTTGKSFYGSGGDYSMFAGKDASRALGKMSKNEEDVSPSLEGLTEKEINTLNDWETKFEAKYPVVGRVVS

SEQ ID NO: 50425 - protein, 72 aa, Zea mays subsp. mays; identical to SEQ ID NO: 9358
  misc_feature: Useful for making plants with modulated nitrogen use efficiency

SEQ ID NO: 50426 - protein, 168 aa, Arabidopsis thaliana
  misc_feature: Useful for making plants with modulated light quality sensitivity
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 50427 - protein, 135 aa, Arabidopsis thaliana
  misc_feature: Useful for making plants with altered alkaloid content
  misc_feature: Useful for making plants with altered terpenoid content
MSLQRPNGNSSSSSSHKKHKTAAGSTCVLSSSADDGVNNPELDQTQNGVSTAKRRRGRNPVDKEYRSLKRLLRNRVSAQQARERKKVYVSDLESRANELQNNNDQLEEKISTLTNENTMLRKMLINTRPKTDDNH

SEQ ID NO: 50428 - protein, 102 aa, Zea mays subsp. mays; identical to SEQ ID NO: 9715
  misc_feature: Useful for making plants with modulated nitrogen use efficiency

SEQ ID NO: 50429 - protein, 180 aa, Arabidopsis thaliana
  misc_feature: Useful for making plants with modulated flowering time
MNILNKLGIGSSRQTNMDPSPIAQVIDDEAPAPGNQFAQFGAGCFWSVELAYQRVPGVTQTEVGYSQGITHDPSYKDVCSGTTNHAEIVRVQYDPKECSYQSLLDLFWSKHDPTTLNRQGNDVGTQYRSGIYFYNPEQEKLARESLERHQQQVDRKVVTEILPAKKFYRAEEHHQQYLSK

SEQ ID NO: 50430 - protein, 782 aa, Arabidopsis thaliana
  misc_feature: Useful for making plants with modulated biomass
MEIESGSYQNAKKESWRTVLTLAYQSLGVVYGDLSISPLYVYKSTFAEDIHHSESNEEIFGVLSFIFWTITLVPLLKYVFIVLRADDNGEGGTFALYSLLCRHARVNSLPSCQLADEQLIEYKTDSIGSSSMPQSGFAASLKSTLEKHGVLQKILLVLALIGTCMVIGDGVLTPAISVFSAVSGVELSMSKEHHKYIELPAACVILIGLFALQHYGTHRVGFLFAPVILLWLMCISAIGVYNIFHWNPHVYQALSPYYMYKFLKKTQSRGWMSLGGILLCITGSEAMFADLGHFSQLSIKIAFTSLVYPSLILAYMGQAAYLSQHHIIESEYNIGFYVSVPERLRWPVLVIAILAAVVGSQAIITGTFSIIKQCSALGCFPKVKIVHTSSKIHGQIYIPEINWILMVLCLAVTIGFRDTKRLGNASGLAVITVMLVTTCLMSLVIVLCWHKSVIFAIVFVVFFGTIESLYFSASLIKFLEGAWVPIALAFCFLLAMCTWHYGTLKRYEYDVQNKVSVNWLLSLSQTLGIARVRGLGLIHTELVSGVPAIFSHFVTNLPAFHQVLVFLCVKSVPVPHVRPQERFLVGRIGPKEFRIYRCIVRFGYRDVHKDDFEFEGDLVCSIAEFIRTEAETAATAAETNGEDDDRMSVVGTCSTYMQGIEDHYESDIDDPDKPGTSEIRSPKPKKKSKSKVKKRVRFVVPETPKIEKETRQELMELTEAREGGVAYIMGNAYMKAKPGSGLLKRLAINIGYEFLRRNTRGPRNMLTSPHASTLEVGMIYNV

SEQ ID NO: 50431 - protein, 108 aa, Arabidopsis thaliana
  misc_feature: Useful for making plants with altered alkaloid content
MKGTFTNLLVLLLIALVCANVGARKVISEDTQFKDEKSFLGGSGSGDGLGLGLGGGAGLGGLGIGAGIGAGAGLGLGGGGGGLGGGGGGLLGGGGFGGGAGGGLGGLP

SEQ ID NO: 50432 - protein, 171 aa, Zea mays; identical to SEQ ID NO: 9516
  misc_feature: Useful for making plants with altered terpenoid content
  misc_feature (81)..(81): Xaa is any aa, unknown, or other

SEQ ID NO: 50433 - protein, 201 aa, Panicum virgatum; identical to SEQ ID NO: 448
  misc_feature: Useful for making plants with altered carbohydrate content

SEQ ID NO: 50434 - protein, 233 aa, Oryza sativa subsp. japonica
  misc_feature: Useful for making plants with modulated biotic stress sensitivity
MSTEAETTSAAAPAPAPAPASAPARCQRIGCDATFTDDNNPDGSCQYHPSGPMFHDGMKQWSCCKQKSHDFSLFLAIPGCKTGKHTTEKPITKAVPTKPSKAVPVQTSKQSVGADTCSRCRQGFFCSDHGSQPKAQIPTATSDTNMVPVEKPAVPPPKKKIDLNEPRVCKNKGCGKTYKEKDNHDEACDYHPGPAVFRDRIRGWKCCDIHVKEFDEFMEIPPCTKGWHNADAA

SEQ ID NO: 50435 - protein, 343 aa, Arabidopsis thaliana
  misc_feature: Useful for making plants with modulated biomass
MNTRYSNQPELSSSNITITISSSALLSSSPRGDNSHVAAANGQERSPSSFYIRLAMKVSRARWFIFLRRVFHYQNGSRSDLGSNPFNSSTWMMSELIALLVQLTVITFTLAISKEERPIWPVRLWITGYDVGCLLNLMLLYGRYRQLDINQGNGFVLGDVEQQQRGREETRSSHLMNKCRTSLELFFAIWFVIGNVWVFDSRFGSFHHAPKLHVLCVSLLAWNAICYSFPFLLFLFLCCLVPLISSLLGYNMNMGSSDRAASDDQISSLPSWKFKRIDDSASDSDSDSATVTDDPECCICLAKYKDKEEVRKLPCSHKFHSKCVDQWLRIISCCPLCKQDLPR

SEQ ID NO: 50436 - protein, 244 aa, Arabidopsis thaliana; identical to SEQ ID NO: 9294
  misc_feature: Useful for making plants with altered alkaloid content
  misc_feature: Useful for making plants with altered lignin content
  misc_feature: Useful for making plants with altered lutein content

SEQ ID NO: 50437 - protein, 248 aa, Glycine max
  misc_feature: Useful for making plants with altered alkaloid content
  misc_feature: Useful for making plants with modulated nitrogen use efficiency
MGSMGNSNPNLNPNPNPNPWTPKDCSEGICSIYCPQWCYKVYSPPPPILLGDGDDDPSGFEFSPLIVAVIGILASTFILVTYYTIISRFCRRRNNTNDSTEDDGNSELARVSSSANSGLDEALIKSITVCKYNKRGGLVEGHDCSVCLSEFEENEDLRLLPKCNHAFHLPCIDTWLKSHATCPLCRASVTACPNPNSSMEPPPRVIVNALEHQQRSNHVVVVVESSEEQEKVVSFDAHTLSDGEGYHT

SEQ ID NO: 50438 - protein, 249 aa, Zea mays
  misc_feature: Useful for making plants with altered terpenoid content
MTSSRQMELHYINTGFPYTITESFMDFFEGLTYAHADFALMDGFQDQGNPYWTMMHTNSYKYGYSGSGNYYSYAHAYDIDDYMHRTDGGRRTWDNTTPVNNVDSANVVLQGGEAPRTTANTTSEDCIQQVHQSPGSPQVVWQDNIDPDNMTYEELLDLGEAVGTQSRGLSQECISLLPITKYKCGFFSRKKTRRERCVICQMEYRRGNLQITLPCKHVYHASCVTRWLSINKVCPVCFAEVPGEDSLRQ

SEQ ID NO: 50439 - protein, 334 aa, Arabidopsis thaliana
  misc_feature: Useful for making plants with modulated biomass
  misc_feature: Useful for making plants with modulated flowering time
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 50440 - protein, 128 aa, Panicum virgatum; identical to SEQ ID NO: 12552
  misc_feature: Useful for making plants with altered carbohydrate content

SEQ ID NO: 50441 - protein, 418 aa, Panicum virgatum
  misc_feature: Useful for making plants with altered carbohydrate content
MGKGLIPADLDTWKQRRKVITPGFHALFIEAMVRIFTKCSERTISKLEQLTASEGQVVMDLEAEFSNLALDIIGLGVFNFDFDSVTKESPVIKAVYGTLFEAEHRSTFYIPYWNLPFTKWIVPRQRKFHSDLKVINDCLDYLIKNAKETRQEADVEKLQQRDYTSLKDVSLLRFLVDMRGADVDDRQLRDDLMTMLIAGHETTAAVLTWSVFLLAQSPTKMRKAQAEVDSVLSNGAITVESLKKLEYIKLIILEALRLYPQPPLLIRRSLQPDKLPGGYNGAKEGYEIPTGTDIFVSAYNLHRSPYFWDRPNEFEPERFSVPKKEESIEGWSGFDPGRSPGAMYPNEIIADFAFLPFGGGPRKCVGDQFALLESTVALSLLLQKFDVELRGSPDEVEMVTGATIHTKNGLWCRLRRRT

SEQ ID NO: 50442 - protein, 164 aa, Arabidopsis thaliana
  misc_feature: Useful for making plants with modulated nitrogen use efficiency
MVLKTELCRFSGQKIYPGRGIRFIRSDSQVFLFLNSKCKRYFHNKLKPSKLCWTAMYRKQHKKDAAQEAVKRRRRATKKPYSRSIVGATLEVIQKKRAEKPEVRDAAREAALREIKERIKKTKDEKKAKKVEYASKQQKSQVKGNIPKSAAPKAAKMGGGGGRR

SEQ ID NO: 50443 - protein, 338 aa, Panicum virgatum; identical to SEQ ID NO: 3352
  misc_feature: Useful for making plants with altered carbohydrate content

SEQ ID NO: 50444 - protein, 164 aa, Arabidopsis thaliana; identical to SEQ ID NO: 9311
  misc_feature: Useful for making plants with modulated flowering time

SEQ ID NO: 50445 - protein, 113 aa, Arabidopsis thaliana; identical to SEQ ID NO: 9555
  misc_feature: Useful for making plants with modulated biomass
  misc_feature: Useful for making plants with modulated flowering time

SEQ ID NO: 50446 - protein, 183 aa, Arabidopsis thaliana
  misc_feature: Useful for making plants with modulated biomass
  misc_feature (152)..(152): Xaa is any aa, unknown, or other
MTQSQTNDGAGAGAVTTVESVPPQPQSQPQPQPQQQSNEMVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDXIQREEQGESTADHKTHGDGTVGWRKREVEDD

SEQ ID NO: 50447 - protein, 462 aa, Zea mays; identical to SEQ ID NO: 9517
  misc_feature: Useful for making plants with altered lignin content

SEQ ID NO: 50448 - protein, 453 aa, Arabidopsis thaliana
  misc_feature: Useful for making plants with modulated nitrogen use efficiency
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 50449 - protein, 160 aa, Arabidopsis thaliana; identical to SEQ ID NO: 9745
  misc_feature: Useful for biocontainment applications

SEQ ID NO: 50450 - protein, 160 aa, Arabidopsis thaliana
  misc_feature: Useful for making plants with modulated nitrogen use efficiency
MATSASALLSPTTFSTAISHKNPNSISFHGLRPLRLGGSSSALPKLSTTGRKSSSTVVRAELSPSIVISLSTGLSLFLGRFVFFNFQRENVAKQGLPEQNGKTHFEAGDDRAKEYVSLLKSNDPIGFNIVDVLAWGSIGHIVAYYILATSSNGYDPSFFG

SEQ ID NO: 50451 - protein, 520 aa, Arabidopsis thaliana
  misc_feature: Useful for making plants with modulated flowering time
MKTTKGGKVMNPTDAYRKQIRKREIKRNKKERQKVREVGILKKDPEQIKDQIRKLDMSKAEGALDKARKHKKRQLEDTLKMVVKKRKEYDEKKKEQGEATTSVMFSHLPPQRRLTGEEDLKPEDSVYYHPTLNPTGAPPPGKPPMYNSSIGLAISSDGASSSSAALSSITESEDSVLVNPPPLPPLPDGDNALSASLPLPPLPPLPPTTGLTLPHSPFPPPPPGPPPKEQDFVRPPLPPPPQLPQSSQPPPPGLSGSQGDGRFPESSDFTFDNRMNANITSVPLLPPPGIPSNESESRPAESNASSFQNANLSKMVAPPPPAPLHQQHQSTFAGAAASLTNFQPDVHPPPGMLRFPPPPPPLDMHPPHPGMFVGHLIPRPPYGPPPGPPPMMRPPLPPGPPPSSFQDGQAMIRPYVPNKPSFVKSAAPTVVRRPLAQHTPELTSMVPASVRVRRESATVTKPKPKTSIASSLSFTPRAMASAATVKVEPAKTSAASKPQSIDDSYTAFLEDMKALGALDG

SEQ ID NO: 50452 - protein, 58 aa, Panicum virgatum; identical to SEQ ID NO: 2040
  misc_feature: Useful for making plants with altered carbohydrate content

SEQ ID NO: 50453 - protein, 119 aa, Arabidopsis thaliana; identical to SEQ ID NO: 9695
  misc_feature: Useful for making plants with modulated biomass

SEQ ID NO: 50454 - protein, 115 aa, Arabidopsis thaliana; identical to SEQ ID NO: 9749
  misc_feature: Useful for making plants with modulated flowering time

SEQ ID NO: 50455 - protein, 97 aa, Arabidopsis thaliana; identical to SEQ ID NO: 9595
  misc_feature: Useful for making plants with modulated nitrogen use efficiency

SEQ ID NO: 50456 - protein, 72 aa, Panicum virgatum; identical to SEQ ID NO: 1378
  misc_feature: Useful for making plants with altered carbohydrate content

SEQ ID NO: 50457 - protein, 74 aa, Arabidopsis thaliana; identical to SEQ ID NO: 9217
  misc_feature: Useful for making plants with altered cell wall content and/or composition
  misc_feature: Useful for making plants with modulated nitrogen use efficiency
  misc_feature: Useful for making plants with modulated salt sensitivity

SEQ ID NO: 50458 - protein, 87 aa, Zea mays subsp. mays; identical to SEQ ID NO: 9394
  misc_feature: Useful for making plants with modulated nitrogen use efficiency

SEQ ID NO: 50459 - protein, 130 aa, Arabidopsis thaliana
  misc_feature: Useful for making plants with modulated nitrogen use efficiency
MEEITDGVNNMNLATDSQKKNRIQVSNTKKPLFFYVNLAKRYMQQYNDVELSALGMAIATVVTVTEILKNNGFAVEKKIMTSTVDIKDDARGRPVQKAKIEITLVKSEKFDELMAAANEEKEDAEAQVQN

SEQ ID NO: 50460 - protein, 80 aa, Arabidopsis thaliana
  misc_feature: Useful for making plants with modulated biomass
MGNESKSNLGGGGIRAKMEHYVYSGEKKHVLAGIGIISIIFGIPWYLMNQGSKHRSHQDYLEKADKARKARLSSSSSSDK

SEQ ID NO: 50461 - protein, 146 aa, Arabidopsis thaliana; identical to SEQ ID NO: 9660
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency

SEQ ID NO: 50462 - protein, 58 aa, Panicum virgatum; identical to SEQ ID NO: 7852
  misc_feature: Useful for making plants with altered carbohydrate content

SEQ ID NO: 50463 - protein, 276 aa, Arabidopsis thaliana; identical to SEQ ID NO: 9562
  misc_feature: Useful for making plants with modulated drought sensitivity

SEQ ID NO: 50464 - protein, 134 aa, Panicum virgatum; identical to SEQ ID NO: 2260
  misc_feature: Useful for making plants with altered carbohydrate content

SEQ ID NO: 50465 - protein, 171 aa, Glycine max
  misc_feature: Useful for making plants with modulated biomass
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSSKKDVQPSPNAQLAHQGSFSQGVSYTISQGQHMMVPMQGPE

SEQ ID NO: 50466 - protein, 393 aa, Arabidopsis thaliana
  misc_feature: Useful for making plants with modulated drought sensitivity
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSWMADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPVMADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYREVW

SEQ ID NO: 50467 - protein, 141 aa, Arabidopsis thaliana
  misc_feature: Useful for making plants with altered alkaloid content
  misc_feature: Useful for making plants with altered terpenoid content
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 50468 - protein, 442 aa, Panicum virgatum; identical to SEQ ID NO: 4670
  misc_feature: Useful for making plants with altered carbohydrate content

SEQ ID NO: 50469 - protein, 528 aa, Panicum virgatum; identical to SEQ ID NO: 13192
  misc_feature: Useful for making plants with altered carbohydrate content

SEQ ID NO: 50470 - protein, 693 aa, Panicum virgatum; identical to SEQ ID NO: 13213
  misc_feature: Useful for making plants with altered carbohydrate content

SEQ ID NO: 50471 - protein, 699 aa, Arabidopsis thaliana
  misc_feature: Useful for making plants with altered cell wall content and/or composition
MAPKFEWWAKGNNNNTRKGTPVVVKMENPNNWSMVELESPSHDDFLVRTHEKSRNKNARQLTWVLLLKAHRAAGCLTSLGSALFALGTAVRRRIAAGRTDIEISSSGVGSLQKQNHTKKSKLFYSCLKVFLWLSLILLGFEIAAYFKGWSFGTSKLQLQFIFNKGFFDWVYTRWVLLRVEYLAPPLQFLANGCIVLFLVQSLDRLILCLGCFWIRFKKIKPVPKPDSISDLESGDNGAFLPMVLVQIPMCNEKEVYQQSIAAVCNLDWPKGKILIQILDDSDDPITQSLIKEEVHKWQKLGARIVYRHRVNREGYKAGNLKSAMNCSYVKDYEFVAIFDADFQPLPDFLKKTIPHFKDNEEIGLVQARWSFVNKEENLLTRLQNINLAFHFEVEQQVNSVFLNFFGFNGTAGVWRIKALEDSGGWLERTTVEDMDIAVRAHLHGWKFVFLNDVECQCELPESYEAYRKQQHRWHSGPMQLFRLCLPAVIKSKISIGKKFNLIFLFFLLRKLILPFYSFTLFCIILPMTMFVPEAELPAWVVCYIPATMSFLNILPAPKSFPFIVPYLLFENTMSVTKFNAMVSGLFQLGSAYEWVVTKKSGRSSEGDLAALVEKDEKTTKHQRGVSAPETEAEKKAEKTKRKKKKHNRIYMKELSLAFLLLTAATRSLLSAQGIHFYFLLFQGISFLLVGLDLIGEQVE

SEQ ID NO: 50472 - protein, 577 aa, Arabidopsis thaliana
  misc_feature: Useful for making plants with modulated nitrogen use efficiency
MSFWLSLIFCFFTFASSSPPDDPVNCEFGNTMCTVTNSYGAFPDRSICKAAKVEYPRTEAELVSIVAAATRAGQKMRVVTRYSHSFPKLVCTDGKDGTLISTKFLNHVVTTNPEAKTLTVESGVTLRQLIEEAAKFDLALPYAPYWWGLTVGGMMGTGAHGSSLWGKGSAVHDYVTEIRLVSPGLASDGYVKVQVLSETIDPEEFRAAKVSLGVLGVISQVTFELQPMFKRSLNYVMRNDSDFGDQAVSFGERHEFADFLWLPSQGKVVYRMDGRVPLNTSGDGLFEFFPFRSQLSLVLAIDRSLEESEESLEDANMKCVRAKLVSSSMFLMSYGVTNNGLIFTGYPVIGMQNHMMSSGSCLDSRQDGLITACPWDPRIKGQFFHQTTFSVSLTNVKSFINDIKALVKIEPKSLCVLEGSNGILIRYVTSSLAFLGKEEKALDFDLTYYRSKNDPLAPRLYEDYIEEIEQMAIFKYNALPHWGKNRNLAFDGAIRKYKNANAFLKVKEKFDSLGLFSTEWTDQILGLKGNVTIVKQGCALEGLCICSEDSHCAPTKGYLCRPGKVYREARVCTRVSS

SEQ ID NO: 50473 - protein, 997 aa, Arabidopsis thaliana
  misc_feature: Useful for making plants with modulated heat sensitivity
MSSSTLQASLFLRPPLHTSSFKLYPCLFSSSSLSFCPQSLSSFYRLSSVLHNSRFRPLPCSLRQDNVASDSDFIPKDSAFEVTDSAESNRLVSDTEVSELETNDRFVGGEETKSGGEEAEVSNGVTEGKEEDQKKSKFRIVVLMMALWAAIKRAIEKVMEWEWLSWWPFSRQEKRLEKLIAEADANPKDAALQGALLAELNKHIPEAVVQRFEQREHTVDSRGVAEYIRALVITNAISEYLPDEQTGKPSSLPALLQELKHRASGNMDESFVNPGISEKQPLHVTMVNPKVSNKSRFAQELVSTILFTVAVGLVWIMGAAALQKYIGSLGGIGTSGVGSSSSYSPKELNKEITPEKNVKTFKDVKGCDDAKQELEEVVEYLKNPSKFTRLGGKLPKGILLTGAPGTGKTLLAKAIAGEAGVPFFYRAGSEFEEMFVGVGARRVRSLFQAAKKKAPCIIFIDEIDAVGSTRKQWEGHTKKTLHQLLVEMDGFEQNEGIIVMAATNLPDILDPALTRPGRFDRHIVVPSPDVRGREEILELYLQGKPMSEDVDVKAIARGTPGFNGADLANLVNIAAIKAAVEGAEKLSSEQLEFAKDRIVMGTERKTMFVSEDSKKLTAYHESGHAIVALNTKGAHPIHKATIMPRGSALGMVTQLPSNDETSVSKRQLLARLDVCMGGRVAEELIFGLDHITTGASSDLSQATELAQYMVSSCGMSEAIGPVHIKERPSSDMQSRIDAEVVKLLREAYERVKSLLKRHEKQLHTLANALLEYETLTAEDIKRILLPKQEGEKFEEQQQEEGDLVLALTAYHESGHAIVALNTKGAHPIHKATIMPRGSALGMVTQLPSNDETSVSKRQLLARLDVCMGGRVAEELIFGLDHITTGASSDLSQATELAQYMVSSCGMSEAIGPVHIKERPSSDMQSRIDAEVVKLLREAYERVKSLLKRHEKQLHTLANALLEYETLTAEDIKRILLPKQEGEKFEEQQQEEGDLVLA

SEQ ID NO: 50474 - protein, 507 aa, Panicum virgatum
  misc_feature: Useful for making plants with altered carbohydrate content
AGGGVWRPLLAGAWLLWLLPWASAVRRSDFPASFLFGTATSSYQIEGAYLEGNKSLSNWDVLTHLPGRIKDGSTGDIADDHYHRFEVRTIDDVELMYSLGTNAYRFSISWARILPRGRFGEVNPEGIKFYNELIDSLLLKGIEPFVTLSHYDMPQELEDRYGAWLSAEIRRDFGHLADVCFAAFGDRVKYWVTFNEPNVVARKGYLLGTYPPERCSPPYGSCARGDSGAEPYLATHNIVLTHATAVEIYKRKYQSKQKGSIGIVMSTTWYKPLTDSPEDRLATERVLAFDVPWFLDPIVYGDYPPEMRQLLGSRLPTFSPEERRKLGYKLDFIGINHYTTLYARDCMFSPGCPLGQQSQPALAATTGERNGIPIGPPTPMPTFYVVPEGIEKIVTYVMKRYNNLPMFITENGYAQGGDGYAHVDDWLDDQGRIQYLDSYLTKLAEVIRDGAEVRGYFVWALMDNFEWLYGYTLRFGLHYVDYQTQERKPKSSALWYKGFLQSLHEAQ

SEQ ID NO: 50475 - protein, 535 aa, Arabidopsis thaliana
  misc_feature: Useful for making plants with altered cell wall content and/or composition
MKKSIVYEIMETKSSMYLSQFRLWLCFIITTLVSLSSSTRWYDDHISLKEIHAEETFHFPKNFLFGTASSAYQYEGAYLTDGKTLSNWDVFTNISGKIADGSHGKVAVDHYHRYPGDLDLMEDLGVNSYRLSLSWARILPKGRFGDVNMGGIDHYNRMINDILKTGIEPFVTLTHYDIPQELEYRYGSWLNPQIREDFEHYANICFRHFGDRVKFWSTFNEPNVQVILGYRTGTYPPSRCSKPFGNCSCGDSYIEPLVAAHNIILSHLAAVNLYRTKFQEQQRGQIGIVMNTIWFEPISDSLADRLAADRAQAFYLTWFLDPVVFGRYPREMREILGDDLPEFTKDDLKSSKNALDFIGINQYTSRYAKDCLHSVCEPGKGGSRAEGFVYANALKDGLRLGEPVGMEEMLMYATERYKNITLYVTENGFGENNTGVLLNDYQRVKFMSNYLDALKRAMRKGADVRGYFAWSLLDNFEWISGYTIRFGMYHVDFSTQERTPRLSASWYKNFIFQHRALSKDDWCLKQKEDTNFFLI

SEQ ID NO: 50476 - protein, 312 aa, Arabidopsis thaliana
  misc_feature: Useful for making plants with altered cell wall content and/or composition
MTFNEPRVVAALGYDNGIFAPGRCSKAFGNCTEGNSATEPYIVTHHLILAHAAAVQRYRKYYQAKQKGRVGILLDFVWYEPLTRSKADNLAAQRARDFHIGWFIHPLVYGEYPKTMQNIVKERLPKFTEKEVKMVKGSIDFVGINQYTTYYMSEPHPTTKPKDLGYQQDWNVEFGFAKLGKPIGPRAYSSWLYNVPWGMYKALMYMKERYGNPTMILSENGMDDPGNVTLAQGLHDTTRIKYYKDYLTNLKKARDDGANVVGYFAWSLLDNFEWLSGYTSRFGIVYVDYKTLKRYPKMSAQWFKQLLKRNNK

SEQ ID NO: 50477 - protein, 266 aa, Arabidopsis thaliana; identical to SEQ ID NO: 9682
  misc_feature: Useful for making plants with altered alkaloid content
  misc_feature: Useful for making plants with modulated nitrogen use efficiency

SEQ ID NO: 50478 - protein, 269 aa, Arabidopsis thaliana
  misc_feature: Useful for making plants with altered lignin content
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 50479 - protein, 271 aa, Arabidopsis thaliana
  misc_feature: Useful for making plants with altered lignin content
  misc_feature: Useful for making plants with altered terpenoid content
MGRTTWFDVDGLRKGEWTAEEDRKLVVYINEHGLGEWGSLPKRAGLQRCGKSCRLRWLNYLRPGIKRGKFTPQEEEEIIKYHALLGNRWAAIAKQMPNRTDNNIKNHWNSCLKKRLAKKGIDPMTHEPTTTTSLTVDVTSSSTTSSPTPSPTSSSFSSCSSTGSARFLNKLAAGISSRKHGLESIKTVILAEQPREAVDEEKMMTINMKEKELISCYMEIDETMSIDELPCDDSTSGFVAFDDYSLIDPYRDSVYVSDFYDETEHLDLFLL

SEQ ID NO: 50480 - protein, 374 aa, Arabidopsis thaliana
  misc_feature: Useful for making plants with modulated low light sensitivity
MGRAPCCDKANVKKGPWSPEEDAKLKDYIENSGTGGNWIALPQKIGLRRCGKSCRLRWLNYLRPNIKHGGFSEEEDNIICNLYVTIGSRWSIIAAQLPGRTDNDIKNYWNTRLKKKLLNKQRKEFQEARMKQEMVMMKRQQQGQGQGQSNGSTDLYLNNMFGSSPWPLLPQLPPPHHQIPLGMMEPTSCNYYQTTPSCNLEQKPLITLKNMVKIEEEQERTNPDHHHQDSVTNPFDFSFSQLLLDPNYYLGSGGGGEGDFAIMSSSTNSPLPNTSSDQHPSQQQEILQWFGSSNFQTEAINDMFINNNNNIVNLETIENTKVYGDASVAGAAVRAALGGGTTSTSADQSTISWEDITSLVNSEDASYFNAPNHV

SEQ ID NO: 50481 - protein, 360 aa, Arabidopsis thaliana
  misc_feature: Useful for making plants with altered protein content
  misc_feature: Useful for making plants with altered terpenoid content
  misc_feature: Useful for making plants with modulated nitrogen use efficiency
MATTVHLSSSSLFSQSRGRRDNSISSVKSLRKRTVLSLSSALTSQDAGHMIQPEGKSNDNNSAFDFKLYMIRKAESVNAALDVSVPLLKPLTIQEAVRYSLLAGGKRVRPLLCIAACELVGGDEATAMSAACAVEMIHTSSLIHDDLPCMDNADLRRGKPTNHKVYGEDMAVLAGDALLALAFEHMTVVSSGLVAPEKMIRAVVELARAIGTTGLVAGQMIDLASERLNPDKVGLEHLEFIHLHKTAALLEAAAVLGVIMGGGTEEEIEKLRKYARCIGLLFQVVDDILDVTKSTEELGKTAGKDVMAGKLTYPRLIGLEGSREVAEKLRREAEEQLLGFDPSKAAPLVALASYIACRHN

SEQ ID NO: 50482 - protein, 360 aa, Arabidopsis thaliana
  misc_feature: Useful for making plants with modulated water use efficiency
MATTVHLSSFSLFIQSRGRRDNSISSVKSLKKRTGLSPSSALTSQGGRDMIPPERKCNDHNSAFDFKLYMIRKAESVNAALDVSVPLREPLTVQEAVRYSLLAGGKRVRPLLCIAVCELVGGDEATAMSAACAVEMIHTSSLIHDDLPCMDNADLRRGKPTNHKVYGEDMAVLAGDALLALAFEHMTVVSSGLVAPERMIRAVVELARAIGTTGLVAGQMIDLASERLNPDKVGLEHLEFIHLHKTAALLEAAAVLGVIMGGGTEEEIEKLRKYARCIGLLFQVVDDIPDVTKSTEELGKTAGKDVMAGKLTYPRLIGLERSKEVAEELRREAEEQLLGFDPSKAAPLVALASYIACRHN

SEQ ID NO: 50483 - protein, 506 aa, Arabidopsis thaliana
  misc_feature: Useful for making plants with altered cell wall content and/or composition
MRGNYLSLLVVLIVLASNDVLANNNSSTPKLRRSDFPEDFIFGSATSAYQVEGGAHEDGRGPSIWDTFSEKYPEKIKDGSNGSVADNSYHLYKEDVALLHQIGFNAYRFSISWSRILPRGNLKGGINQAGIDYYNNLINELLSKGIKPFATMFHWDTPQALEDAYGGFRGAEIVNDFRDYADICFKNFGDRVKHWMTLNEPLTVVQQGYVAGVMAPGRCSKFTNPNCTDGNGATEPYIVGHNLILSHGAAVQVYREKYKASQQGQVGIALNAGWNLPYTESPKDRLAAARAMAFTFDYFMEPLVTGKYPVDMVNNVKGRLPIFTAQQSKMLKGSYDFIGINYYSSTYAKDVPCSTKDVTMFSDPCASVTGERDGVPIGPKAASDWLLIYPKGIRDLVLYAKYKFKDPVMYITENGRDEFSTNKIFLKDGDRIDYYARHLEMVQDAISVGANVKGFFAWSLLDNFEWAMGYTVRFGLVYVDFKDGCKRYPKKSAEWFRKLLNEKKND

SEQ ID NO: 50484 - protein, 546 aa, Panicum virgatum; identical to SEQ ID NO: 13263
  misc_feature: Useful for making plants with altered carbohydrate content

SEQ ID NO: 50485 - protein, 481 aa, Arabidopsis thaliana
  misc_feature: Useful for making plants with modulated nitrogen use efficiency
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 50486 - protein, 248 aa, Panicum virgatum; identical to SEQ ID NO: 4544
  misc_feature: Useful for making plants with altered carbohydrate content

SEQ ID NO: 50487 - protein, 232 aa, Arabidopsis thaliana
  misc_feature: Useful for making plants with altered cell wall content and/or composition
VNGYAGGGWVNAHATFYGGGDASGTMGGACGYGNLYSQGYGTNTAALSTALFNNGLSCGACFEIRCQNDGKWCLPGSIVVTATNFCPPNNALPNNAGGWCNPPQQHFDLSQPVFQRIAQYRAGIVPVAYRRVPCVRRGGIRFTINGHSYFNLVLITNVGGAGDVHSAMVKGSRTGWQAMSRNWGQNWQSNSYLNGQSLSFKVTTSDGQTIVSNNVANAGWSFGQTFTGAQLR

SEQ ID NO: 50488 - protein, 249 aa, Arabidopsis thaliana
  misc_feature: Useful for making plants with altered cell wall content and/or composition
MGHLGFLVMIMVGVMASSVSGYGGGWINAHATFYGGGDASGTMGGACGYGNLYSQGYGTSTAALSTALFNNGLSCGSCFEIRCENDGKWCLPGSIVVTATNFCPPNNALANNNGGWCNPPLEHFDLAQPVFQRIAQYRAGIVPVSYRRVPCRRRGGIRFTINGHSYFNLVLITNVGGAGDVHSAAIKGSRTVWQAMSRNWGQNWQSNSYLNGQALSFKVTTSDGRTVVSFNAAPAGWSYGQTFAGGQFR

SEQ ID NO: 50489 - protein, 193 aa, Arabidopsis thaliana; identical to SEQ ID NO: 9203
  misc_feature: Useful for making plants with altered cell wall content and/or composition
  misc_feature: Useful for making plants with altered lignin content

SEQ ID NO: 50490 - protein, 475 aa, Arabidopsis thaliana
  misc_feature: Useful for making plants with altered cell wall content and/or composition
MGSGVGVALFALSLLLVSHEVESAIGVNWGTLSFHKMRPSTVVDLLKANKITKVKLFDANPDALRALMGTGIQVMIGIPNEMLSTFNSDLFVQQNLSRFIGKNGADIRYVAVGNEPFLTGYGGQFQNYVVPTMVNLQQSLVRANLASYVKLVVPCNADAYQSNVPSQGMFRPELTQIMTQLVSFLNSNGSPFVVNIYPFLSLYGNSDFPQDYAFFEGSSHPVPDGPNTYYNAFDGNFDTLVAALTKLGYGQMPIVIGEIGWPTDGAVGANLTAARVFNQGLISHVLSNKGTPLRPGSPPADVYLFGLLDEGAKSTLPGNFERHWGIFSFDGQAKYRLNLGLGNRGLKNAKNVQYLPSRWCVAHPSRDMTQVGDHLRLACSEADCTTLNDGGSCSQLGEKDNISYAFNSYYQMQMQHEKSCDFDGLGMVTFLDPSVGDCRFLVGVTDIGLSSSTEPMARWSIYHICIGLLIWTLTM

SEQ ID NO: 50491 - protein, 492 aa, Panicum virgatum; identical to SEQ ID NO: 3952
  misc_feature: Useful for making plants with altered carbohydrate content

SEQ ID NO: 50492 - protein, 494 aa, Arabidopsis thaliana
  misc_feature: Useful for making plants with modulated nitrogen use efficiency
MVLATNSDSDEHLHSTFASRYVRAVVPRFKMPDHCMPKDAAYQVINDELMLDGNPRLNLASFVTTWMEPECDKLIMDSVNKNYVDMDEYPVTTELQNRCVNMIANFFHAPVGEDEAAIGCGTVGSSEAIMLAGLAFKRKWQHRRKAQGLPIDKPNIVTGANVQVCWEKFARYFEVELKEVKLSEDYYVMDPAKAVEMVDENTICVAAILGSTLTGEFEDVKQLNDLLAEKNAETGWETPIHVDAASGGFIAPFLYPDLEWDFRLPWVKSINVSGHKYGLVYAGVGWVVWRTKDDLPEELVFHINYLGADQPTFTLNFSKGSSQIIAQYYQFIRLGFEGYKNIMENCMDNARRLREGIEMTGKFNIVSKDIGVPLVAFSLKDSSKHTVFEIAESLRKFGWIIPAYTMPADAQHIAVLRVVIREDFSRGLADRLITHIIQVLKEIEGLPSRIAHLAAAAAVSGDDEEVKVKTAKMSLEDITKYWKRLVEHKRNIVC

SEQ ID NO: 50493 - protein, 171 aa, Zea mays; identical to SEQ ID NO: 9284
  misc_feature: Useful for making plants with altered oil content

SEQ ID NO: 50494 - protein, 569 aa, Arabidopsis thaliana
  misc_feature: Useful for making plants with modulated flowering time
MALRTLSTFPSLPRRHTTTRREPNLTVIYRNPTTSIVCKSIANSEPPVSLSERDGFAAAAPTPGERFLENQRAHEAQKVVKKEIKKEKKKKKEEIIARKVVDTSVSCCYGCGAPLQTSDVDSPGFVDLVTYELKKKHHQLRTMICGRCQLLSHGHMITAVGGNGGYPGGKQFVSADELREKLSHLRHEKALIVKLVDIVDFNGSFLARVRDLVGANPIILVITKIDLLPKGTDMNCIGDWVVEVTMRKKLNVLSVHLTSSKSLDGVSGVASEIQKEKKGRDVYILGAANVGKSAFINALLKTMAERDPVAAAAQKYKPIQSAVPGTTLGPIQINAFVGGEKLYDTPGVHLHHRQAAVVHSDDLPALAPQNRLRGQSFDVSLLYYGQISTLPTQSSSSPKGESLNGYTFFWGGLVRIDILKALPETCFTFYGPKALEIHAVPTKTATAFYEAKLGVLLTPPSGKNQMQEWKGLQSHRLLQIEINDAKRPASDVAISGLGWISIEPIRKTRGTEPRDLNEAEHEIHICVSVPKPVEVFLRPTLPIGTSGTEWYQYRELTDKEEEVRPKWYF

SEQ ID NO: 50495 - protein, 549 aa, Panicum virgatum; identical to SEQ ID NO: 7412
  misc_feature: Useful for making plants with altered carbohydrate content

SEQ ID NO: 50496 - protein, 561 aa, Arabidopsis thaliana
  misc_feature: Useful for making plants with altered lignin content
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVAMKEEAAGEVPVAFVVKSKDSELSEDDVKQFVSKQVVFYKRINKVFFTESIPKAPSGKILRKDLRAKLANGL

SEQ ID NO: 50497 - protein, 556 aa, Arabidopsis thaliana
  misc_feature: Useful for making plants with altered cell wall content and/or composition
MTTQDVIVNDQNDQKQCSNDVIFRSRLPDIYIPNHLPLHDYIFENISEFAAKPCLINGPTGEVYTYADVHVTSRKLAAGLHNLGVKQHDVVMILLPNSPEVVLTFLAASFIGAITTSANPFFTPAEISKQAKASAAKLIVTQSRYVDKIKNLQNDGVLIVTTDSDAIPENCLRFSELTQSEEPRVDSIPEKISPEDVVALPFSSGTTGLPKGVMLTHKGLVTSVAQQVDGENPNLYFNRDDVILCVLPMFHIYALNSIMLCSLRVGATILIMPKFEITLLLEQIQRCKVTVAMVVPPIVLAIAKSPETEKYDLSSVRMVKSGAAPLGKELEDAISAKFPNAKLGQGYGMTEAGPVLAMSLGFAKEPFPVKSGACGTVVRNAEMKILDPDTGDSLPRNKPGEICIRGNQIMKGYLNDPLATASTIDKDGWLHTGDVGFIDDDDELFIVDRLKELIKYKGFQVAPAELESLLIGHPEINDVAVVAMKEEDAGEVPVAFVVRSKDSNISEDEIKQFVSKQVVFYKRINKVFFTDSIPKAPSGKILRKDLRARLANGLMN

SEQ ID NO: 50498 - protein, 1165 aa, Arabidopsis thaliana
  misc_feature: Useful for making plants with modulated light quality sensitivity
MKAPSSNGVSPNPVEGERRNINSELWHACAGPLISLPPAGSLVVYFPQGHSEQVAASMQKQTDFIPSYPNLPSKLICMLHNVTLNADPETDEVYAQMTLQPVNKYDRDALLASDMGLKLNRQPNEFFCKTLTASDTSTHGGFSVPRRAAEKIFPALDFSMQPPCQELVAKDIHDNTWTFRHIYRGQPKRHLLTTGWSVFVSTKRLFAGDSVLFIRDGKAQLLLGIRRANRQQPALSSSVISSDSMHIGVLAAAAHANANNSPFTIFYNPRWAAPAEFVVPLAKYTKAMYAQVSLGMRFRMIFETEECGVRRYMGTVTGISDLDPVRWKNSQWRNLQIGWDESAAGDRPSRVSVWDIEPVLTPFYICPPPFFRPRFSGQPGMPDDETDMESALKRAMPWLDNSLEMKDPSSTIFPGLSLVQWMNMQQQNGQLPSAAAQPGFFPSMLSPTAALHNNLGGTDDPSKLLSFQTPHGGISSSNLQFNKQNQQAPMSQLPQPPTTLSQQQQLQQLLHSSLNHQQQQSQSQQQQQQQQLLQQQQQLQSQQHSNNNQSQSQQQQQLLQQQQQQQLQQQHQQPLQQQTQQQQLRTQPLQSHSHPQPQQLQQHKLQQLQVPQNQLYNGQQAAQQHQSQQASTHHLQPQLVSGSMASSVITPPSSSLNQSFQQQQQQSKQLQQAHHHLGASTSQSSVIETSKSSSNLMSAPPQETQFSRQVEQQQPPGLNGQNQQTLLQQKAHQAQAQQIFQQSLLEQPHIQFQLLQRLQQQQQQQFLSPQSQLPHHQLQSQQLQQLPTLSQGHQFPSSCTNNGLSTLQPPQMLVSRPQEKQNPPVGGGVKAYSGITDGGDAPSSSTSPSTNNCQISSSGFLNRSQSGPAILIPDAAIDMSGNLVQDLYSKSDMRLKQELVGQQKSKASLTDHQLEASASGTSYGLDGGENNRQQNFLAPTFGLDGDSRNSLLGGANVDNGFVPDTLLSRGYDSQKDLQNMLSNYGGVTNDIGTEMSTSAVRTQSFGVPNVPAISNDLAVNDAGVLGGGLWPAQTQRMRTYTKVQKRGSVGRSIDVNRYRGYDELRHDLARMFGIEGQLEDPQTSDWKLVYVDHENDILLVGDDPWEEFVNCVQSIKILSSAEVQQMSLDGNFAGVPVTNQACSGGDSGNAWRGHYDDNSATSFNR

SEQ ID NO: 50499 - protein, 1081 aa, Arabidopsis thaliana
  misc_feature: Useful for making plants with altered cell wall content and/or composition
  misc_feature: Useful for making plants with modulated biomass
MEASAGLVAGSYRRNELVRIRHESDGGTKPLKNMNGQICQICGDDVGLAETGDVFVACNECAFPVCRPCYEYERKDGTQCCPQCKTRFRRHRGSPRVEGDEDEDDVDDIENEFNYAQGANKARHQRHGEEFSSSSRHESQPIPLLTHGHTVSGEIRTPDTQSVRTTSGPLGPSDRNAISSPYIDPRQPVPVRIVDPSKDLNSYGLGNVDWKERVEGWKLKQEKNMLQMTGKYHEGKGGEIEGTGSNGEELQMADDTRLPMSRVVPIPSSRLTPYRVVIILRLIILCFFLQYRTTHPVKNAYPLWLTSVICEIWFAFSWLLDQFPKWYPINRETYLDRLAIRYDRDGEPSQLVPVDVFVSTVDPLKEPPLVTANTVLSILSVDYPVDKVACYVSDDGSAMLTFESLSETAEFAKKWVPFCKKFNIEPRAPEFYFAQKIDYLKDKIQPSFVKERRAMKREYEEFKVRINALVAKAQKIPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNIVFFDINMKGLDGIQGPVYVGTGCCFNRQALYGYDPVLTEEDLEPNIIVKSCCGSRKKGKSSKKYNYEKRRGINRSDSNAPLFNMEDIDEGFEGYDDERSILMSQRSVEKRFGQSPVFIAATFMEQGGIPPTTNPATLLKEAIHVISCGYEDKTEWGKEIGWIYGSVTEDILTGFKMHARGWISIYCNPPRPAFKGSAPINLSDRLNQVLRWALGSIEILLSRHCPIWYGYHGRLRLLERIAYINTIVYPITSIPLIAYCILPAFCLITDRFIIPEISNYASIWFILLFISIAVTGILELRWSGVSIEDWWRNEQFWVIGGTSAHLFAVFQGLLKVLAGIDTNFTVTSKATDEDGDFAELYIFKWTALLIPPTTVLLVNLIGIVAGVSYAVNSGYQSWGPLFGKLFFALWVIAHLYPFLKGLLGRQNRTPTIVIVWSVLLASIFSLLWVRINPFVDANPNANNFNGKGGVF

SEQ ID NO: 50500 - protein, 621 aa, Arabidopsis thaliana
  misc_feature: Useful for making plants with altered cell wall content and/or composition
MYGRDPWGGPLEINTADSATDDDRSRNLNDLDRAALSRPLDETQQSWLLGPTEQKKKKYVDLGCIIVSRKIFVWTVGTLVAAALLAGFITLIVKTVPRHHPKTPPPDNYTIALHKALKFFNAQKSGKLPKHNNVSWRGNSGLQDGKGETGSFYKDLVGGYYDAGDAIKFNFPMAYAMTMLSWSVIEYSAKYEAAGELTHVKELIKWGTDYFLKTFNSTADSIDDLVSQVGSGNTDDGNTDPNDHYCWMRPEDMDYKRPVTTCNGGCSDLAAEMAAALASASIVFKDNKEYSKKLVHGAKVVYQFGRTRRGRYSAGTAESSKFYNSSMYWDEFIWGGAWMYYATGNVTYLNLITQPTMAKHAGAFWGGPYYGVFSWDNKLAGAQLLLSRLRLFLSPGYPYEEILRTFHNQTSIVMCSYLPIFNKFNRTNGGLIELNHGAPQPLQYSVNAAFLATLYSDYLDAADTPGWYCGPNFYSTSVLRDFARSQIDYILGKNPRKMSYVVGFGTKYPRHVHHRGASIPKNKVKYNCKGGWKWRDSKKPNPNTIEGAMVAGPDKRDGYRDVRMNYNYTEPTLAGNAGLVAALVALSGEEEATGKIDKNTIFSAVPPLFPTPPPPPAPWKP

SEQ ID NO: 50501 - protein, 623 aa, Panicum virgatum; identical to SEQ ID NO: 4600
  misc_feature: Useful for making plants with altered carbohydrate content

SEQ ID NO: 50502 - protein, 585 aa, Panicum virgatum; identical to SEQ ID NO: 13433
  misc_feature: Useful for making plants with altered carbohydrate content

SEQ ID NO: 50503 - protein, 428 aa, Panicum virgatum; identical to SEQ ID NO: 6988
  misc_feature: Useful for making plants with altered carbohydrate content

SEQ ID NO: 50504 - protein, 741 aa, Arabidopsis thaliana
  misc_feature: Useful for making plants with modulated biomass
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 50505 - protein, 399 aa, Panicum virgatum; identical to SEQ ID NO: 13465
  misc_feature: Useful for making plants with altered carbohydrate content

SEQ ID NO: 50506 - protein, 393 aa, Arabidopsis thaliana
  misc_feature: Useful for making plants with altered cell wall content and/or composition
MKIISLSISIGIAIIAVLASKTLFKTHPEAFGIKAISYSFKKSLCDHHHHHHHHHHHHHRHKPSDTKRKVSICDDFPKNIPPLDTDTTSYLCVDKNGCCNFTTVQSAVDAVGNFSQRRNVIWINSGMYYEKVVIPKTKPNITLQGQGFDITAIAWNDTAYSANGTFYCATVQVFGSQFVAKNISFMNVAPIPKPGDVGAQAVAIRIAGDESAFVGCGFFGAQDTLHDDRGRHYFKDCYIQGSIDFIFGNAKSLYQDCRIISMANQLSPGSKAVNGAVTANGRSSKDENSGFSFVNCTIGGTGHVWLGRAWRPYSRVVFVSTTMTDVIAPEGWNNFNDPSRDATIFYGEYNCSGPGADMSKRAPYVQKLNETQVALLINTSFIDGDQWLQFSDL

SEQ ID NO: 50507 - protein, 293 aa, Panicum virgatum; identical to SEQ ID NO: 5766
  misc_feature: Useful for making plants with altered carbohydrate content

SEQ ID NO: 50508 - protein, 575 aa, Arabidopsis thaliana
  misc_feature: Useful for making plants with modulated light quality response
  misc_feature: Useful for making plants with modulated light quality sensitivity
MADAYEPYHVLQQSRRDKLRIPSLDSHFHFHPPPPPSSGGGGGVFPLADSDFLAAGGFHSNNNNNHISNPSYSNFMGFLGGPSSSSSTAVAVAGDHSFNAGLSSGDVLVFKPEPLSLSLSSHPRLAYDLVVPGVVNSGFCRSAGEANAAAVTIASRSSGPLGPFTGYASILKGSRFLKPAQMLLDEFCNVGRGIYTDKVIDDDDSSLLFDPTVENLCGVSDGGGGDNGKKKSKLISMLDEVYKRYKQYYEQLQAVMGSFECVAGLGHAAPYANLALKALSKHFKCLKNAITDQLQFSHNNKIQQQQQCGHPMNSENKTDSLRFGGSDSSRGLCSAGQRHGFPDHHAPVWRPHRGLPERAVTVLRAWLFDHFLHPYPTDTDKLMLAKQTGLSRNQVSNWFINARVRVWKPMVEEIHMLETRQSQRSSSSSWRDERTSTTVFPDNNNNNPSSSSAQQRPNNSSPPRRARNDDVHGTNNNNSYVNSGSGGGSAVGFSYGIGSSNVPVMNSSTNGGVSLTLGLHHQIGLPEPFPMTTAQRFGLDGGSGDGGGGYEGQNRQFGRDFIGGSNHQFLHDFVG

SEQ ID NO: 50509 - protein, 454 aa, Arabidopsis thaliana; identical to SEQ ID NO: 9480
  misc_feature: Useful for making plants with modulated oxidative stress sensitivity

SEQ ID NO: 50510 - protein, 201 aa, Panicum virgatum
  misc_feature: Useful for making plants with altered carbohydrate content
MAAPPLLLLVGALALLAQEQVARCDAAATCVGVAPAKRRPEVVSIADFGGVGDGRTLNTWAFRKAVYRIQHRRRRGGTELRVPAGTWLTGSFNLTSHMTLFLARGAVLKATRDAAGWPLVEPLPSYGRGRELPGPRYASFINGNGLRDVVITGDKGVIDGQGEVWWNMWRQRTLQHTRPNLVEFMHSTGIHISNIVLKNSP

SEQ ID NO: 50511 - protein, 449 aa, Arabidopsis thaliana
  misc_feature: Useful for making plants with altered cell wall content and/or composition
MKISQAPISVFVLFLLSTVLPHHLSLGAPITCSGIVPMKHRNEMLSISDFGAVGDGKTLNTKAFNSAIDRIRNSNNSNEGTLLYVPRGVYLTQSFNLTSHMTLYLADGAVIKAVQDTEKWPLTDPLPSYGRGREHPGRRYISFIHGDGLNDVVITGRNGTIDGQGEPWWNMWRHGTLKFTRPGLIEFNNSTNILVSHVVLQNSPFWTLHPVYCSNVVVHHVTILAPTDSYNTDGIDPDSSSNVCIEDSYISTGDDLVAVKSGWDEYGIAYNRPSRDITIRRITGSSPFAGIAIGSETSGGIQNVTVENITLYNSGIGIHIKTNIGRGGSIQGITISGVYLEKVRTGIKISGDTGDHPDDKFNTSALPIVRGITIKNVWGIKVERAGMVQGLKDSPFTNLCFSNVTLTGTKRSPIWKCSDVVGAADKVNPTPCPELSATTQQGGSCENQS

SEQ ID NO: 50512 - protein, 78 aa, Arabidopsis thaliana
  misc_feature: Useful for making plants with modulated nitrogen use efficiency
MEIKVKTLTEKQIDIEIELTDTIERIKERIEEKEGIPPVHQRIVYTGKQLADDLTAKHYNLERGSVLHLVLALRGGCC

SEQ ID NO: 50513 - protein, 441 aa, Arabidopsis thaliana
  misc_feature: Useful for biocontainment applications
  misc_feature: Useful for making plants with modulated biomass
  misc_feature: Useful for making plants with modulated flowering time
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRWINGQPL

SEQ ID NO: 50514 - protein, 358 aa, Arabidopsis thaliana; identical to SEQ ID NO: 9662
  misc_feature: Useful for making plants with modulated drought sensitivity

SEQ ID NO: 50515 - protein, 613 aa, Arabidopsis thaliana
  misc_feature: Useful for making plants with modulated flowering time
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 50516 - protein, 193 aa, Zea mays
  misc_feature: Useful for making plants with altered terpenoid content
MELDADNLSATELRLGLPGTSSSSRDDWQKKPSPSVGAKRVLDDGTKSEASGTSTAAGDLDFDHDTAAPPKAQVVGWPPVRAYRKNTFQAAAAKKVEQKQQQGGLYVKVSMDGAPYLRKGGPPDVQGVQGAQGGSGRALHQLLLRGGGRGRRRPPARHRLRGQGRRPHARRRRALGYVHLFLQEAEDNEGLCL

SEQ ID NO: 50517 - protein, 732 aa, Arabidopsis thaliana
  misc_feature: Useful for making plants with modulated biomass
MSNQKKRNFQIEAFKHRVVVDPKYADKTWQILERAIHQIYNQDASGLSFEELYRNAYNMVLHKFGEKLYTGFIATMTSHLKEKSKLIEAAQGGSFLEELNKKWNEHNKALEMIRDILMYMDRTYIESTKKTHVHPMGLNLWRDNVVHFTKIHTRLLNTLLDLVQKERIGEVIDRGLMRNVIKMFMDLGESVYQEDFEKPFLDASSEFYKVESQEFIESCDCGDYLKKSEKRLTEEIERVAHYLDAKSEEKITSVVEKEMIANHMQRLVHMENSGLVNMLLNDKYEDLGRMYNLFRRVTNGLVTVRDVMTSHLREMGKQLVTDPEKSKDPVEFVQRLLDERDKYDKIINTAFGNDKTFQNALNSSFEYFINLNARSPEFISLFVDDKLRKGLKGITDVDVEVILDKVMMLFRYLQEKDVFEKYYKQHLAKRLLSGKTVSDDAERSLIVKLKTECGYQFTSKLEGMFTDMKTSEDTMRGFYGSHPELSEGPTLIVQVLTTGSWPTQPAVPCNLPAEVSVLCEKFRSYYLGTHTGRRLSWQTNMGTADIKAIFGKGQKHELNVSTFQMCVLMLFNNSDRLSYKEIEQATEIPAADLKRCLQSLACVKGKNVIKKEPMSKDIGEEDLFVVNDKFTSKFYKVKIGTVVAQKETEPEKQETRQRVEEDRKPQIEAAIVRIMKSRKILDHNNIIAEVTKQLQPRFLANPTEIKKRIESLIERDFLERDSTDRKLYRYLA

SEQ ID NO: 50518 - protein, 394 aa, Panicum virgatum; identical to SEQ ID NO: 13685
  misc_feature: Useful for making plants with altered carbohydrate content

SEQ ID NO: 50519 - protein, 460 aa, Arabidopsis thaliana
  misc_feature: Useful for making plants with altered cell wall content and/or composition
MSLLLHLFALSLLISVSGAKFSGRPGINYGQLGNNLPSPSDSVNLIKSLNAKRVKLYDANPKILAALNGTDITVSVMVPNELLVNISKSASLSDDWIRSNILPFYPTTKIRYLLVGNEILSLPDSELKSSLVPAMRKIQRSLKSLGVKKVKVGTTLATDVLQSSFPPSSGEFREDISGLIMKPMLQFLNRTKSFLFVDVYPYFAWAQDPTHVDLDYAIFESTNVTVTDPVSNLTYHNLFDQMIDAFVFAMKRVGYPDIRIWVAETGWPNNGDYDQIGANIYNAATYNRNVVKKLAADPPVGTPARPGKVLPAFVFALYNENQKTGPGTERHFGLLHPNGTQVYGIDLSGKTEYKESLPAPENNDLYKGKIWCVVAKGANWTQLGDALSYACSQGNNTCDPIQRGGPCQKPDLTVLHASYAFSSYWAQFRKIGGTCSFNGLATQTIKDPSYGRCEFPSVTL

SEQ ID NO: 50520 - protein, 185 aa, Arabidopsis thaliana; identical to SEQ ID NO: 9376
  misc_feature: Useful for making plants with altered alkaloid content

SEQ ID NO: 50521 - protein, 277 aa, Panicum virgatum; identical to SEQ ID NO: 5478
  misc_feature: Useful for making plants with altered carbohydrate content

SEQ ID NO: 50522 - protein, 216 aa, Arabidopsis thaliana; identical to SEQ ID NO: 9467
  misc_feature: Useful for making plants with modulated oxidative stress sensitivity

SEQ ID NO: 50523 - protein, 351 aa, Arabidopsis thaliana
  misc_feature: Useful for making plants with altered oil content
DDDDDDDDDEVDGDDNEKEKIGLYELKKGNLTVKFTNWGASIISLHFPDKNGKMDDIVLGYDSVKTYKTDKVYFGATVGRVANRIGKGKFKLNGKEYKTSVNDGKNTLHGGKKGFGDVVWAVAKHQYDGKKPHIVFTHTSPDGDQGFPGELSVTVTYKLVKDNELSVVMEAKPKDKATPVNLAHHSYWNLGGHNSGDILSEEIQILGSGYTPVDGELIPTGKINPVKGTAYDFLQLRPIKDNMKDLKTGYDINYCLDGKAKKMRKIVELVDKKSGRKMELSGNQAGLQFYTGGMLKDVKGKNGAVYQAFGGLCLETQSYPDALNHPKFPSQIVEPGKKYKHTMLFKFSIVS

SEQ ID NO: 50524 - protein, 638 aa, Arabidopsis thaliana
  misc_feature: Useful for making plants with modulated nitrogen use efficiency
MESTIVMMMMITRSFFCFLGFLCLLCSSVHGLLSPKGVNFEVQALMDIKASLHDPHGVLDNWDRDAVDPCSWTMVTCSSENFVIGLGTPSQNLSGTLSPSITNLTNLRIVLLQNNNITGKIPAEIGRLTRLETLDLSDNFFHGEIPFSVGYLQSLQYLRLNNNSLSGVFPLSLSNMTQLAFLDLSYNNLSGPVPRFAAKTFSIVGNPLICPTGTEPDCNGTTLIPMSMNLNQTGVPLYAGGSRNHKMAIAVGSSVGTVSLIFIAVGLFLWWRQRHNQNTFFDVKDGNHHEEVSLGNLRRFGFRELQIATNNFSSKNLLGKGGYGNVYKGILGDSTVIAVKRLKDGGALGGEIQFQTEVEMISLAVHRNLLRLYGFCITQTEKLLVYPYMSNGSVASRMKAKPVLDWSIRKRIAIGAARGLVYLHEQCDPKIIHRDVKAANILLDDYCEAVVGDFGLAKLLDHQDSHVTTAVRGTVGHIAPEYLSTGQSSEKTDVFGFGILLLELVTGQRAFEFGKAANQKGVMLDWVKKIHQEKKLELLVDKELLKKKSYDEIELDEMVRVALLCTQYLPGHRPKMSEVVRMLEGDGLAEKWEASQRSDSVSKCSNRINELMSSSDRYSDLTDDSSLLVQAMELSGPR

SEQ ID NO: 50525 - protein, 158 aa, Arabidopsis thaliana; identical to SEQ ID NO: 9740
  misc_feature: Useful for making plants with modulated biomass

SEQ ID NO: 50526 - protein, 340 aa, Arabidopsis thaliana
  misc_feature: Useful for making plants with modulated biomass
MAAMAAKLQLSAKSDQSSVRLPRVINLSRDPTTRVSFPRNGSVCSLHTNFSSPHLAKPCAGGGGGGSTGNNGGGSGSGGGGGGFGGSGGEASEESSPWGPIGLFIQGWRSRVAADPQFPFKVLMEEIVGLSACVLGDMASRPNFGLNELDFVFSTLVVGSILNFVLMYMLAPTAATLGSSQTLPGIFRNCPSSHMFEQGSFTVMNRFGTLVYKGMVFASVGLAAGLVGTAISNGLIMLRKKMDPSFETPNKPPPTVLNSLTWATHMGVSANARYQTLNGIEFLLAKVLPPLVFKTSVIVLRCANNVAGGMSFVLLARMTGSQSVEEKTEMSEISEKEKDD

SEQ ID NO: 50527 - protein, 209 aa, Brassica napus; identical to SEQ ID NO: 9259
  misc_feature: Useful for making plants with modulated salt sensitivity

SEQ ID NO: 50528 - protein, 1520 aa, Arabidopsis thaliana; identical to SEQ ID NO: 9708
  misc_feature: Useful for making plants with modulated salt sensitivity

SEQ ID NO: 50529 - protein, 234 aa, Glycine max; identical to SEQ ID NO: 9589
  misc_feature: Useful for making plants with altered terpenoid content
  misc_feature: Useful for making plants with modulated flowering time
  misc_feature (44)..(44): Xaa is any aa, unknown, or other

SEQ ID NO: 50530 - protein, 99 aa, Arabidopsis thaliana; identical to SEQ ID NO: 9281
  misc_feature: Useful for making plants with modulated biomass
  misc_feature: Useful for making plants with modulated flowering time

SEQ ID NO: 50531 - protein, 89 aa, Arabidopsis thaliana
  misc_feature: Useful for making plants with modulated flowering time
  misc_feature: Useful for making plants with modulated time to senescence
MSGRKETVLDLAKFVDKGVQVKLTGGRQVTGTLKGYDQLLNLVLDEAVEFVRDHDDPLKTTDQTRRLGLIVCRGTGDACLTNRWHRRNR

SEQ ID NO: 50532 - protein, 126 aa, Zea mays; identical to SEQ ID NO: 9386
  misc_feature: Useful for making plants with modulated biomass
  misc_feature: Useful for making plants with modulated flowering time

SEQ ID NO: 50533 - protein, 124 aa, Arabidopsis thaliana; identical to SEQ ID NO: 9345
  misc_feature: Useful for making plants with modulated phosphate use efficiency

SEQ ID NO: 50534 - protein, 236 aa, Arabidopsis thaliana
  misc_feature: Useful for making plants with modulated biomass
MDVGRNNRKNMSFRSSPEKSKQELRRSFSAQKRMMIPANYFSLESLFLLVGLTASLLILPLVLPPLPPPPFMLLLVPIGIMVLLVVLAFMPSSHSNANTDVTCNFMMIREISNLQKDIINIQDSYSNNRVMDVGRNNRKNMSFRSSPEKSKQELRRSFSAQKRMMIPANYFSLESLFLLVGLTASLLILPLVLPPLPPPPFMLLLVPIGIMVLLVVLAFMPSSHSNANTDVTCNFM

SEQ ID NO: 50535 - protein, 569 aa, Panicum virgatum; identical to SEQ ID NO: 1810
  misc_feature: Useful for making plants with altered carbohydrate content

SEQ ID NO: 50536 - protein, 580 aa, Arabidopsis thaliana
  misc_feature: Useful for making plants with altered cell wall content and/or composition
MDVTKSLLCFISFVAFLLFSSVAEANKAHHHEFIIQATKVKRLCETHNSITVNGMFPGPMLVVNNGDTLVVKVINRARYNITIHWHGVRQMRTGWADGPEFVTQCPIRPGSSYTYRFTIQGQEGTLWWHAHSSWLRATVYGSLLVFPPAGSSYPFTKPHRNVPLLLGEWWDANPVDVLRESIRTGGAPNNSDAYTINGQPGDLYKCSSQDTTVVPINVGETILLRVINSALNQPLFFTVANHKLTVVGADASYLKPFTTNVIVLGPGQTTDVLITGDQPPNRYYMAARAYQSAQNAPFGNTTTTAILQYKSAPCCGVGGGSGTKKGNSFKPIMPILPAYNDTNTVTRFSQSFRSLRRAEVPTEIDENLFVTIGLGLNNCPKNFRSRRCQGPNGTRFTASMNNVSFALPSNYSLLQAHHHGIPGVFTTDFPAKPPVKFDYTGNNISRSLYQPDRGTKLYKLKYGSRVQIVLQDTGIVTPENHPIHLHGYDFYIIAEGFGNFNPKKDTAKFNLEDPPLRNTVGVPVNGWAVIRFIADNPGVWIMHCHLDAHISWGLAMAFLVENGNGVLQTIEQPPHDLPVC

SEQ ID NO: 50537 - protein, 69 aa, Arabidopsis thaliana
  misc_feature: Useful for making plants with modulated nitrogen use efficiency
MASNEAGRALPKFGEWDVNDPATADGFTVIFSKAGEDKKTGRSSTKTNSQRKQDGDKPAVKKWLCFTFA

SEQ ID NO: 50538 - protein, 464 aa, Panicum virgatum
  misc_feature: Useful for making plants with altered carbohydrate content
MLPLLLLLATAALAAAQGLPPLPIGVNYGANADNLPSPAAVATFLAAKTTVNRVKLFDANPAFLDAFAANAPGISIAVSIPNAALTGFADRAAGLDAARGWVRDNLAAHVARGANVTLLLAGNEIPGPTVVPDLVVALLPAMRRLSQALQLEGLPQVRVTTPHYLGILAPSDGIPSNARFRPGLDTKVLAPMLRFHNDTGSPLMVNAYPYFSYNAQNLNYAIFRPNAGVYDPATKLNYTSMFDAQMDAIYTAMKKLGYGDVQIAVGEAGWPTQADAGQVGVGPEEARDFNAGMIRVCSGGKGTPLMPGRTFETYVFSLFDENQKPDPIAERNFGIFNPDFTPKYDLGLLRDGSSSASPNPSPNPSPKPSPNPSPSGGGKWCVAKAGADATTLQNNINYACGFVDCKPIQSGGGCFDPNNVQSHASFVMNAYYQANGRHDYDCDFKDTGMVTSSDPSYGGCKYVS

SEQ ID NO: 50539 - protein, 183 aa, Panicum virgatum; identical to SEQ ID NO: 14163
  misc_feature: Useful for making plants with altered carbohydrate content

SEQ ID NO: 50540 - protein, 63 aa, Arabidopsis thaliana
  misc_feature: Useful for making plants with altered cell wall content and/or composition
MASLKFPLEILAVFVIISVILLPIAQSHSSSPAPAPTSDGTSIDQGIAYVLMMVALALTYFIH

SEQ ID NO: 50541 - protein, 196 aa, Arabidopsis thaliana; identical to SEQ ID NO: 9291
  misc_feature: Useful for making plants with modulated biomass

SEQ ID NO: 50542 - protein, 73 aa, Arabidopsis thaliana; identical to SEQ ID NO: 9472
  misc_feature: Useful for making plants with modulated flowering time

SEQ ID NO: 50543 - protein, 72 aa, Arabidopsis thaliana; identical to SEQ ID NO: 9734
  misc_feature: Useful for making plants with modulated time to senescence

SEQ ID NO: 50544 - protein, 88 aa, Arabidopsis thaliana; identical to SEQ ID NO: 9368
  misc_feature: Useful for making plants with modulated cold sensitivity
  misc_feature: Useful for making plants with modulated drought sensitivity

SEQ ID NO: 50545 - protein, 128 aa, Arabidopsis thaliana
  misc_feature: Useful for making plants with modulated oxidative stress sensitivity
MGISKALRSLLILLLLNITFFFGHVTPGATVKPCPPPPAKQATTKCPRDTLKFGVCGSWLGLVSEVIGTPPSQECCSLIKGLADFEAAVCLCTALKTSILGVAPVKIPVALTLLLNSCGKNVPQGFVC

SEQ ID NO: 50546 - protein, 59 aa, Arabidopsis thaliana
  misc_feature: Useful for making plants with altered cell wall content and/or composition
MEAMKMRLFVAVLVAAMAFSAVQQAAAVEAPAPSPTSDASLAIPAFFASVATLAFGFLF

SEQ ID NO: 50547 - protein, 156 aa, Arabidopsis thaliana; identical to SEQ ID NO: 9579
  misc_feature: Useful for making plants with modulated biomass

SEQ ID NO: 50548 - protein, 263 aa, Panicum virgatum; identical to SEQ ID NO: 14318
  misc_feature: Useful for making plants with altered carbohydrate content

SEQ ID NO: 50549 - protein, 436 aa, Arabidopsis thaliana
  misc_feature: Useful for making plants with modulated nitrogen use efficiency
MGFQNEASSSSYTLKIPPPAREDTPLLGKGPPLSSQFKTFANVFIAVVGAGVLGLPYAFKRTGWLMGVLLLVSVSVLTHHCMMLLVYTRRKLDSFNAGISKIGSFGDLGFAVCGSLGRIVVDLFIILSQAGFCVGYLIFIGTTLANLSDPESPTSLRHQFTRLGSEFLGVSSKSLYIWGCFPFQLGLNSIKTLTHLAPLSIFADIVDLGAMAVVIVEDSMIILKQRPDVVAFGGMSLFLYGMGVAVYSFEGVGMVLPLESEMKDKDKFGKVLALGMGFISLIYIAFGILGYLAFGEDTMDIITANLGAGLVSTVVQLGLCINLFFTFPLMMNPVFEIVERRFSRGMYSAWLRWVLVLAVTLVALFVPNFADFLSLVGSSTCCVLGFVLPALFHLLVFKEEMGWLQWSSDTAIVVLGVVLAVSGTWSSLSEIFSVKV

SEQ ID NO: 50550 - protein, 162 aa, Arabidopsis thaliana
  misc_feature: Useful for making plants with modulated biomass
MLLGKRQRPPINRTTSLSEIKFDLNLPSESEPSNQQKPTVASPYGSNGQAVTAAVDQNRGFLDQRLLSMVTPRGNLRRHSGDFSDARHFLRSCALCERLLVPGRDIYMYRGDKAFCSSECRQEQMAQDERKEKGKSAAPAKEPAVTAPARAKPGKGRAAAAV

SEQ ID NO: 50551 - protein, 147 aa, Arabidopsis thaliana
  misc_feature: Useful for making plants with modulated nitrogen use efficiency
MLLGKRQRPPIKRTTSLSEIKFDLNQPSEQEPSDHQIQLVNVDEHRQVHQRLLDQRLLAMVSPRGTQRRHSSDYSEDFLRSCSLCKRLLVHGRDIYMYRGDRAFCSLECRQQQITVDERKEKKKGSVRSTIVVATGTTTGERVSAAV

SEQ ID NO: 50552 - protein, 364 aa, Panicum virgatum; identical to SEQ ID NO: 7170
  misc_feature: Useful for making plants with altered carbohydrate content

SEQ ID NO: 50553 - protein, 578 aa, Arabidopsis thaliana; identical to SEQ ID NO: 9252
  misc_feature: Useful for making plants with altered lignin content

SEQ ID NO: 50554 - protein, 357 aa, Arabidopsis thaliana
  misc_feature: Useful for making plants with altered cell wall content and/or composition
  misc_feature: Useful for making plants with altered lignin content
MGIMEAERKTTGWAARDPSGILSPYTYTLRETGPEDVNIRIICCGICHTDLHQTKNDLGMSNYPMVPGHEVVGEVVEVGSDVSKFTVGDIVGVGCLVGCCGGCSPCERDLEQYCPKKIWSYNDVYINGQPTQGGFAKATVVHQKFVVKIPEGMAVEQAAPLLCAGVTVYSPLSHFGLKQPGLRGGILGLGGVGHMGVKIAKAMGHHVTVISSSNKKREEALQDLGADDYVIGSDQAKMSELADSLDYVIDTVPVHHALEPYLSLLKLDGKLILMGVINNPLQFLTPLLMLGRKVITGSFIGSMKETEEMLEFCKEKGLSSIIEVVKMDYVNTAFERLEKNDVRYRFVVDVEGSNLDA

SEQ ID NO: 50555 - protein, 224 aa, Panicum virgatum; identical to SEQ ID NO: 14457
  misc_feature: Useful for making plants with altered carbohydrate content

SEQ ID NO: 50556 - protein, 391 aa, Arabidopsis thaliana
  misc_feature: Useful for biocontainment applications
  misc_feature: Useful for making plants with modulated biomass
  misc_feature: Useful for making plants with modulated flowering time
MAEVEEIAHEEQNIEKREKKKGKHEKPKPWDDDPNIDRWTIEKFDPAWNPTGMTETSTFSTLFPQYREKYLQECWPRVESALKEYGVACKLNLVEGSMTVSTTRKTRDPYIIVKARDLIKLLSRSVPAPQAIKILEDEVQCDIIKIGNLVRNKERFVKRRQRLVGPNSSTLKALEILTNCYILVQGSTVAAMGPFKGLKQLRRIVEDCVQNIMHPVYHIKTLMMKKELEKDPALANESWDRFLPTFRKKNVKQKKPKSKEKKPYTPFPPPQPPSKIDMQLESGEYFMRDKKKSEKKWQEKQEKQSEKSTENKRKRDASFLPPEEPMNNNSNANKSEDGKNDITELTNSLKSKTKELKKQKKTHERVNAEEYIAGPSSSADKSSKKSKKIRD

SEQ ID NO: 50557 - protein, 193 aa, Panicum virgatum; identical to SEQ ID NO: 16409
  misc_feature: Useful for making plants with altered carbohydrate content

SEQ ID NO: 50558 - protein, 492 aa, Panicum virgatum; identical to SEQ ID NO: 14539
  misc_feature: Useful for making plants with altered carbohydrate content

SEQ ID NO: 50559 - protein, 505 aa, Arabidopsis thaliana
  misc_feature: Useful for making plants with altered cell wall content and/or composition
MLLPRWFAEALLLLLSILACSNAAFIGVNIGTDLTNMPPPSDIVTLLKSQQITHVRLYDANSHMLKAFANTSIEVMVGVTNEEILKIGRFPSAAAAWVNKNVAAYIPSTNITAIAVGSEVLTTIPHVAPILASALNNIHKALVASNLNFKVKVSSPMSMDIMPKPFPPSTSTFSPSWNTTVYQLLQFLKNTGSFFMLNAYPYYGYTTANGIFPLDYALFKQLSPVKQIVDPNTLLHYNSMFDAMVDAAYYSMEALNFSKIPVVVTETGWPSSGGSDEAAATVANAETFNTNLIKRVLNNSGPPSQPDIPINTYIYELYNEDKRSGPVSERNWGILFPNGTSVYPLSLSGGSSSAALNGSSMFCVAKADADDDKLVDGLNWACGQGRANCAAIQPGQPCYLPNDVKSHASFAFNDYYQKMKSAGGTCDFDGTAITTTRDPSYRTCAYTGSLNANATNGNFPPDALGPASPLGGNANARIIFSYHLPILAPLALTLLQLLLQHDRLL

SEQ ID NO: 50560 - protein, 449 aa, Arabidopsis thaliana
  misc_feature: Useful for making plants with modulated oxidative stress sensitivity
MYIKAIMNRHRLLSAATDECNKKLGQACSSSLSPVHNFLNVQPEHRKTPFIRSQSPDSPGQLWPKNSSQSTFSRSSTFCTNLYLSSSSTSETQKHLGNSLPFLPDPSSYTHSASGVESARSPSIFTEDLGNQCDGGNSGSLLKDFLNLSGDACSDGDFHDFGCSNDSYCLSDQMELQFLSDELELAITDRAETPRLDEIYETPLASNPVTRLSPSQSCVPGAMSVDVVSSHPSPGSAANQKSRMRWTPELHESFVKAVIKLEGPEKATPKAVKKLMNVEGLTIYHVKSHLQKYRLAKYMPEKKEEKRTDNSEEKKLALSKSEADEKKKGAIQLTEALRMQMEVQKQLHEQQEVQRVLQLRIEEHAKYLEKMLEEQRKTGRWISSSSQTVLSPSDDSIPDSQNMSKTKASSPQPPLPAENKASETEDDKCESPQKRRRLENIAESEDPKR

SEQ ID NO: 50561 - protein, 206 aa, Arabidopsis thaliana
  misc_feature: Useful for making plants with modulated carbon-nitrogen partitioning
MFAIKSAKVVNLVGVLETVLISCIQGTGALAVATKLPELRPPTCHHGEACIPATAFQMTILYVSLYLIALGTGGLKSSISGFGSDQFDDKDPKEKAHMAFFFNRFFFFISMGTLLAVTVLVYMQDEVGRSWAYGICTVSMAIAIVIFLCGTKRYRYKKSQGSPVVQIFQVIAAAFRKRKMELPQSIVYLYEDNPEGIRIEHTDQFQ

SEQ ID NO: 50562 - protein, 332 aa, Arabidopsis thaliana
  misc_feature: Useful for making plants with altered terpenoid content
MGNALTFLYGKCCKPTTTDDSLGPHGVSAATVGVSALAHDLFNFEITSQVPEGLGRYVQSSRKAQANWYRKILEAWKQAKPPPQTAEEASRLVTDILKRNQKADVEGLLSFYGLPLSHTLVEVTVEAPVSLPEGILFEFQTLPVDPKAVADGDTITVYVSTSEPVVSSSVPREVNLAAVQRAKAREKRNYPKADELHQKIIDSGYRVLNIENEEVLARKFRIRLRGIDAPESQMPFGKEAQEGLLKIVGRKSLKVLVYGEDQYGRCVGDLYCNGIFVQEAMLKKGLAWHYLAYDKRPVLAKWEKEARQKRIGLWASSNPEKPWDWRKNNRRE

SEQ ID NO: 50563 - protein, 332 aa, Panicum virgatum; identical to SEQ ID NO: 14594
  misc_feature: Useful for making plants with altered carbohydrate content

SEQ ID NO: 50564 - protein, 326 aa, Arabidopsis thaliana
  misc_feature: Useful for making plants with altered cell wall content and/or composition
  misc_feature: Useful for making plants with modulated phosphate use efficiency
MTRFGLALLMILVIQGLVTFSEAQLKMGFYDQTCPYAEKIVQDVVNQHINNAPSLAAGLIRMHFHDCFVRGCDGSILINATSSNQQVEKLAPPNLTVRGFDFIDKVKSALESKCPGIVSCADIITLATRDSIVAIGGPTWNVPTGRRDGRISNFAEAMNNIPPPFGNFTTLITLFGNQGLDVKDLVLLSGAHTIGVSHCSSFSNRLFNFTGVGDQDPSLDSEYADNLKSRRCLSIADNTTKVEMDPGSRNTFDLSYYRLVLKRRGLFESDAALTMNPAALAQVKRFAGGSEQEFFAEFSNSMEKMGRIGVKTGSDGEIRRTCAFVN

SEQ ID NO: 50565 - protein, 633 aa, Panicum virgatum; identical to SEQ ID NO: 17756
  misc_feature: Useful for making plants with altered carbohydrate content

SEQ ID NO: 50566 - protein, 618 aa, Arabidopsis thaliana
  misc_feature: Useful for making plants with altered cell wall content and/or composition
MIPSSSPMESRHRLSFSNEKTSRRRFQRIEKGVKFNTLKLVLICIMLGALFTIYRFRYPPLQIPEIPTSFGLTTDPRYVATAEINWNHMSNLVEKHVFGRSEYQGIGLINLNDNEIDRFKEVTKSDCDHVALHLDYAAKNITWESLYPEWIDEVEEFEVPTCPSLPLIQIPGKPRIDLVIAKLPCDKSGKWSRDVARLHLQLAAARVAASSKGLHNVHVILVSDCFPIPNLFTGQELVARQGNIWLYKPNLHQLRQKLQLPVGSCELSVPLQAKDNFYSAGAKKEAYATILHSAQFYVCGAIAAAQSIRMSGSTRDLVILVDETISEYHKSGLVAAGWKIQMFQRIRNPNAVPNAYNEWNYSKFRLWQLTEYSKIIFIDADMLILRNIDFLFEFPEISATGNNATLFNSGLMVVEPSNSTFQLLMDNINEVVSYNGGDQGYLNEIFTWWHRIPKHMNFLKHFWEGDEPEIKKMKTSLFGADPPILYVLHYLGYNKPWLCFRDYDCNWNVDIFQEFASDEAHKTWWRVHDAMPENLHKFCLLRSKQKAQLEWDRRQAEKGNYKDGHWKIKIKDKRLKTCFEDFCFWESMLWHWGETNSTNNSSTTTTSSPPHKTALPSL

SEQ ID NO: 50567 - protein, 338 aa, Zea mays; identical to SEQ ID NO: 9398
  misc_feature: Useful for making plants with altered lignin content

SEQ ID NO: 50568 - protein, 321 aa, Arabidopsis thaliana
  misc_feature: Useful for making plants with modulated water use efficiency
MVTIRSGSIVILVLLAVSFLALVANGEDKTIKVKKVRGNKVCTQGWECSWWSKYCCNQTISDYFQVYQFEQLFSKRNTPIAHAVGFWDYQSFITAAALFEPLGFGTTGGKLMGQKEMAAFLGHVASKTSCGYGVATGGPLAWGLCYNREMSPMQSYCDESWKFKYPCSPGAEYYGRGALPIYWNFNYGAAGEALKADLLNHPEYIEQNATLAFQAAIWRWMTPIKRAQPSAHDIFVGNWKPTKNDTLSKRGPTFGSTMNVLYGEYTCGQGSIDPMNNIISHYLYFLDLMGIGREDAGPNDELSCAEQKPFNPSTVPSSSSS

SEQ ID NO: 50569 - protein, 321 aa, Arabidopsis thaliana; identical to SEQ ID NO: 50568
  misc_feature: Useful for making plants with altered cell wall content and/or composition

SEQ ID NO: 50570 - protein, 110 aa, Glycine max
  misc_feature: Useful for biocontainment applications
MSKRVRSPRLELRLNLSPPRAAATSIISSSELSPTESSMSSPVSVQSLESSCVSSEAEETRAMLLVGCPRCLMYVMLSEVDPKCPKCKSTVLLDFLNNEENNNTKKSSSE

SEQ ID NO: 50571 - protein, 115 aa, Arabidopsis thaliana
  misc_feature: Useful for making plants with modulated flowering time
MVRGKTQMKRIENATSRQVTFSKRRNGLLKKAFELSVLCDAEVSLIIFSPKGKLYEFASSNMQDTIDRYLRHTKDRVSTKPVSEENMQHLKYEAANMMKKLNNSKLLNVNSWEKA

SEQ ID NO: 50572 - protein, 170 aa, Arabidopsis thaliana; identical to SEQ ID NO: 9372
  misc_feature: Useful for making plants with modulated nitrogen use efficiency

SEQ ID NO: 50573 - protein, 122 aa, Arabidopsis thaliana; identical to SEQ ID NO: 9436
  misc_feature: Useful for making plants with modulated nitrogen use efficiency

SEQ ID NO: 50574 - protein, 147 aa, Arabidopsis thaliana; identical to SEQ ID NO: 9442
  misc_feature: Useful for making plants with modulated nitrogen use efficiency

SEQ ID NO: 50575 - protein, 108 aa, Arabidopsis thaliana; identical to SEQ ID NO: 9626
  misc_feature: Useful for making plants with modulated biomass
  misc_feature: Useful for making plants with modulated flowering time

SEQ ID NO: 50576 - protein, 336 aa, Zea mays; identical to SEQ ID NO: 9440
  misc_feature: Useful for making plants with altered alkaloid content
  misc_feature: Useful for making plants with altered lignin content

SEQ ID NO: 50577 - protein, 283 aa, Arabidopsis thaliana
  misc_feature: Useful for making plants with altered terpenoid content
MYPSLDDDFVSDLFCFDQSNGAELDDYTQFGVNLQTDQEDTFPDFVSYGVNLQQEPDEVFSIGASQLDLSSYNGVLSLEPEQVGQQDCEVVQEEEVEINSGSSGGAVKEEQEHLDDDCSRKRARTGSCSRGGGTKACRERLRREKLNERFMDLSSVLEPGRTPKTDKPAILDDAIRILNQLRDEALKLEETNQKLLEEIKSLKAEKNELREEKLVLKADKEKTEQQLKSMTAPSSGFIPHIPAAFNHNKMAVYPSYGYMPMWHYMPQSVRDTSRDQELRPPAA

SEQ ID NO: 50578 - protein, 101 aa, Arabidopsis thaliana; identical to SEQ ID NO: 9423
  misc_feature: Useful for making plants with altered lignin content

SEQ ID NO: 50579 - protein, 58 aa, Arabidopsis thaliana
  misc_feature: Useful for making plants with altered cell wall content and/or composition
  misc_feature: Useful for making plants with altered lignin content
MEAMKMKMMVFIMVVAVAFSAATAATVEAPAPSPTSDAAMFVPALFASVVALASGFIF

SEQ ID NO: 50580 - protein, 231 aa, Zea mays
  misc_feature: Useful for making plants with altered lignin content
  misc_feature: Useful for making plants with altered terpenoid content
MESKQWGKTPQEVVGAGGGRQVDLDEEDDLEEFRLPMGHRPTENLDTEGLQQASVYTQLTASNVGFRLLQKMGWKTGKGLGKNEQGILEPIRADMRDAKLGVGKQEEDDFFTSEENVQRKKLNIELEETEEHIKKREVIAEREHKIRSEVKEIQKVFFCNLCNKQYKLAHEFESHLSSYDHNHRKRFKEMREMQSSSGSRDDRQKREQQREEKELAKIAQLADAHRKQQKG

SEQ ID NO: 50581 - protein, 241 aa, Zea mays
  misc_feature: Useful for making plants with altered lignin content
MGANGHPPASTVAQNGSHSGGGGGGGGGVNPSNGGTGAALRHDPGLAREWSTEEQTILDELLVKYASDLPVVRYAKVAMKLPEKTVRDVALRCRWMNKKESAKRKKEDHNSSKKSKDKKEKVSDSSSKPPVHMVGRPNVPPYPLPVLPMDDDEISSKAIGGPTGEILETNAHVLGQISSNLSNMQIQDNISLLCQTRDNILRVLKEINDAPDIMKQMPPLPVKINEELVNSLLPRPTVPMQ

SEQ ID NO: 50582 - protein, 656 aa, Panicum virgatum; identical to SEQ ID NO: 27524
  misc_feature: Useful for making plants with altered carbohydrate content

SEQ ID NO: 50583 - protein, 310 aa, Arabidopsis thaliana
  misc_feature: Useful for making plants with modulated biomass
  misc_feature: Useful for making plants with modulated heat sensitivity
MDVAAMARCVGRCYVSPAFGESESHRLSERRFLKLSSSTNSDPAGSKSLKLRGKIHRRMSYFRPIMAKDESISSRSGETKQINGKQKNIVWHDCPVTKSDRQELIKHKGCVIWITGLSGSGKSSLACALSRALHNRGKLSYILDGDNVRHGLNSDLSFEADDRAENIRRVGEVAKLFADSGIICIASLISPYRIERAACRALLPQGDFIEVFMDVPLHVCEARDPKGLYKRARAGKIKGFTGVDDPYEAPLDCEIVIQNSRDKGLSSSSSSSSSPSSSSSSLCEMADIVVSYLDQNGYLKKHSTKSRDCM

SEQ ID NO: 50584 - protein, 282 aa, Arabidopsis thaliana; identical to SEQ ID NO: 9493
  misc_feature: Useful for biocontainment applications
  misc_feature (187)..(187): Xaa is any aa, unknown, or other
  misc_feature (193)..(193): Xaa is any aa, unknown, or other
  misc_feature (264)..(264): Xaa is any aa, unknown, or other

SEQ ID NO: 50585 - protein, 399 aa, Arabidopsis thaliana
  misc_feature: Useful for making plants with modulated nitrogen use efficiency
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 50586 - protein, 519 aa, Panicum virgatum; identical to SEQ ID NO: 2386
  misc_feature: Useful for making plants with altered carbohydrate content

SEQ ID NO: 50587 - protein, 633 aa, Arabidopsis thaliana
  misc_feature: Useful for making plants with modulated flowering time
MLLRVCCPSSFFYLRPLHLFSSTAKVPFCPSLPRQFRLSPSRSSSFRRMESSPASSSSPTPVTDSSADSLAKDLQNQSLGAVDEGVKIKKKLEDFNWDHSFVKELPGDPRTDVISREVLHACYSKVSPSVEVDDPQLVAWSVSVAELLDLDPKEFERPDFPLMLSGAKPLPGAMSYAQCYGGHQFGMWAGQLGDGRAITLGEVLNSKGERWELQLKGAGRTPYSRFADGLAVLRSSIREFLCSETMHCLGIPTTRALCLLTTGQNVTRDMFYDGNPKEEPGAIVCRVSQSFLRFGSYQIHASRGKEDLDIVRKLADYAIKHHFPHIESMDRSDSLSFKTGDEDDSVVDLTSNKYAAWIVEIAERTATLVARWQGVGFTHGVLNTDNMSILGQTIDYGPFGFLDAFDPSYTPNTTDLPGRRYCFANQPDIGLWNIAQFSKTLAVAQLINQKEANYAMERYGDKFMDEYQAIMSKKLGLTKYNKEVISKLLNNMSVDKVDYTNFFRLLANVKANPNTPENELLKPLKAVLLDIGKERKEAWIKWMRSYIQEVGGSEVSDEERKARMDSVNPKYILRNYLCQSAIDAAEQGDFSEVNNLIRLMKRPYEEQPGMEKYARLPPAWAYRPGVCMLSCSS

SEQ ID NO: 50588 - protein, 395 aa, Arabidopsis thaliana; identical to SEQ ID NO: 9404
  misc_feature: Useful for making plants with modulated low light sensitivity
  misc_feature: Useful for making plants with modulated nitrogen use efficiency

SEQ ID NO: 50589 - protein, 442 aa, Arabidopsis thaliana
  misc_feature: Useful for making plants with modulated nitrogen use efficiency
MLKIKRVPTVVSNYQKDDGAEDPVGCGRNCLGACCLNGARLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVSPIEYGHVLLIPRVLDCLPQRIDHKSLLLAVHMAAEAANPYFRLGYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAIGCSNQEEDLEGTIVHQQNSSGNVNQKSNRTHGGPITNGTAAECLVLQ

SEQ ID NO: 50590 - protein, 393 aa, Panicum virgatum; identical to SEQ ID NO: 15083
  misc_feature: Useful for biocontainment applications

SEQ ID NO: 50591 - protein, 518 aa, Panicum virgatum; identical to SEQ ID NO: 3526
  misc_feature: Useful for making plants with altered carbohydrate content

SEQ ID NO: 50592 - protein, 476 aa, Panicum virgatum; identical to SEQ ID NO: 3200
  misc_feature: Useful for making plants with altered carbohydrate content

SEQ ID NO: 50593 - protein, 401 aa, Arabidopsis thaliana [sequence omitted]

SEQ ID NO: 50594 - protein, 237 aa, Arabidopsis thaliana
  misc_feature: Useful for making plants with modulated nitrogen use efficiency
DLGAAPSGAIVLLHACAHNPTGVDPTSEQWEQIRQLMRSKSLLPFFDSAYQGFASGSLDTDAQSVRTFVADGGECLIAQSYAKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 50595 - protein, 461 aa, Arabidopsis thaliana [sequence omitted]

SEQ ID NO: 50596 - protein, 106 aa, Zea mays; identical to SEQ ID NO: 9382
  misc_feature: Useful for making plants with altered lignin content
  misc_feature: Useful for making plants with altered terpenoid content
  misc_feature (29)..(29): Xaa is any aa, unknown, or other

SEQ ID NO: 50597 - protein, 33 aa, Arabidopsis thaliana; identical to SEQ ID NO: 9688
  misc_feature: Useful for making plants with modulated cold sensitivity

SEQ ID NO: 50598 - protein, 363 aa, Arabidopsis thaliana; identical to SEQ ID NO: 9181
  misc_feature: Useful for biocontainment applications
  misc_feature: Useful for making plants with modulated biomass
  misc_feature: Useful for making plants with modulated time to senescence

SEQ ID NO: 50599 - protein, 343 aa, Arabidopsis thaliana
  misc_feature: Useful for making plants with modulated water use efficiency
MERYEIVKDIGSGNFGVAKLVRDKFSKELFAVKFIERGQKIDEHVQREIMNHRSLIHPNIIRFKEVLLTATHLALVMEYAAGGELFGRICSAGRFSEDEARFFFQQLISGVNYCHSLQICHRDLKLENTLLDGSEAPRVKICDFGYSKSGVLHSQPKTTVGTPAYIAPEVLSTKEYDGKIADVWSCGVTLYVMLVGAYPFEDPSDPKDFRKTIGRILKAQYAIPDYVRVSDECRHLLSRIFVANPEKRITIEEIKNHSWFLKNLPVEMYEGSLMMNGPSTQTVEEIVWIIEEARKPITVATGLAGAGGSGGSSNGAIGSSSMDLDDLDTDFDDIDTADLLSPL

SEQ ID NO: 50600 - protein, 445 aa, Panicum virgatum; identical to SEQ ID NO: 2548
  misc_feature: Useful for making plants with altered carbohydrate content

SEQ ID NO: 50601 - protein, 431 aa, Arabidopsis thaliana
  misc_feature: Useful for making plants with altered cell wall content and/or composition
MRLLFSFCFFFFMIIFTATAYDPLDPSGNITIKWDIMSWTADGYVATVTMNNFQIYRHIQNPGWTLGWTWAKKEVIWSMVGAQTTEQGDCSKFKGNVPHCCKKTPTVVDLLPGVPYNQQFSNCCKGGVIGAWGQDPSAAVSQFQVSAGLAGTTNKTVKLPKNFTLLGPGPGYTCGPAKIVPSTVFLTTDKRRKTQALMTWNVTCTYSQFLARKHPSCCVSFSSFYNDTITPCPSCACGCENKKSCVKADSKILTKKGLNTPKKDNTPLLQCTHHMCPVRVHWHVKTNYKDYWRVKIAITNFNYRMNHTLWTLAIQHPNLNNVTQVFSFDYKPVSPYGSINDTGMFYGTKFYNDLLMEAGPSGNVQSEVLLQKDQKTFTFKQGWAFPRKVYFNGDECMLPPPDSYPFLPNSAQGNFASFSLTILLLLFISIW

SEQ ID NO: 50602 - protein, 452 aa, Arabidopsis thaliana; identical to SEQ ID NO: 9631
  misc_feature: Useful for making plants with altered cell wall content and/or composition
  misc_feature: Useful for making plants with altered lignin content

SEQ ID NO: 50603 - protein, 466 aa, Glycine max
  misc_feature: Useful for making plants with modulated nitrogen use efficiency
MALAFTSSISAPTSTFPSSEPKLPQIGSIRISERPIGGAVNFNLSQRRSLVKPVNAEPPRKDSIVPLAATTIVASASETKEEDFEQIASDLDNASPLEIMDRALDKFGNDIAIAFSGAEDVALIEYAKLTGRPFRVFSLDTGRLNPETYQLFDAVEKHYGIRIEYMFPDAVEVQALVRSKGLFSFYEDGHQECCRVRKVRPLRRALKGLRAWITGQRKDQSPGTRSEIPVVQVDPAFEGMDGGIGSLVKWNPVANVKGHDIWNFLRTMNVPVNSLHAKGYVSIGCEPCTRPVLPGQHEREGRWWWEDAKAKECGLHKGNVKQQKEEDVNGNGLSQSHANGDATTVPDIFNSPNVVNLSRTGIENLAKLEDRKEPWLVVLYAPWCPYCQAMEESYVDLADKLAGSTGMKVGKFRADGEQKEFAKSELQLGSFPTILFFPKHSSRPTIKYPSEKRDVDSLMAFVNALR

SEQ ID NO: 50604 - protein, 635 aa, Panicum virgatum; identical to SEQ ID NO: 15217
  misc_feature: Useful for making plants with altered carbohydrate content

SEQ ID NO: 50605 - protein, 351 aa, Arabidopsis thaliana
  misc_feature: Useful for making plants with modulated salt sensitivity
MFTFFTILSLCFKSWEQIITMEASKEAHHLPNYMKDDNVSQETKNLITSLPSDKDFMGYGLYNYKGCWYYPNTLQAVLDVQKHFKPRDTDIILASLPKGGTTWLKSLIFAVVHREKYRGTPQTHPLLLQNPHDLVPFLEVELYANSQIPDLAKYSSPMIFSTHMHLQALREATTKACKTVYVCRGIKDTFVSGWHYRNMLHRTKMDQATFELMFDAYCRGVLLYGPYWEHVLSYWKGSLEAKENVLFMKYEEIIEEPRVQVKRLAEFLECPFTKEEEESGSVEEILKLCSLRNLSNLEVNKNGTTRIGVDSQVFFRKGEVGDWKNHLTPQMAKTFDEIIDYRLGDSGLIFQ

SEQ ID NO: 50606 - protein, 359 aa, Arabidopsis thaliana
  misc_feature: Useful for making plants with modulated drought sensitivity
  misc_feature: Useful for making plants with modulated water use efficiency
MATSSMKSIPMAIPSFSMCHKLELLKEGKTRDVPKAEEDEGLSCEFQEMLDSLPKERGWRTRYLYLFQGFWCQAKEIQAIMSFQKHFQSLENDVVLATIPKSGTTWLKALTFTILNRHRFDPVASSTNHPLFTSNPHDLVPFFEYKLYANGDVPDLSGLASPRTFATHLPFGSLKETIEKPGVKVVYLCRNPFDTFISSWHYTNNIKSESVSPVLLDQAFDLYCRGVIGFGPFWEHMLGYWRESLKRPEKVFFLRYEDLKDDIETNLKRLATFLELPFTEEEERKGVVKAIAELCSFENLKKLEVNKSNKSIKNFENRFLFRKGEVSDWVNYLSPSQVERLSALVDDKLGGSGLTFRLS

SEQ ID NO: 50607 - protein, 425 aa, Panicum virgatum; identical to SEQ ID NO: 5222
  misc_feature: Useful for making plants with altered carbohydrate content

SEQ ID NO: 50608 - protein, 236 aa, Arabidopsis thaliana
  misc_feature: Useful for making plants with altered cell wall content and/or composition
MAAHGVKTLIYSSTCATYGEPEKMPITEETPQVPINPYGKAKKMAEDIILDFSKNSIMAVMILRYFNVIGSDPEGRLGEAPRPELSEHGRISGACFDAARGIIPGLQIKGTDYKTVDGTCVRDYIDVTDLVDAHVKALEKAKPRKVGIFNVGTGKGSSVKEFVEACKKATGVDIKVDYLERRAGDYAEVYSDPRKIKEELNWTAKHTNLQESLKMAWRWQKLHRSGYGSSSLVSAY

SEQ ID NO: 50609 - protein, 251 aa, Populus balsamifera subsp. trichocarpa
  misc_feature: Useful for making plants with altered lignin content
MRKPDLVGKDRVPSNSSINKAKLRKGLWSPEEDEKLIKYMLTNGQGCWSDIARNAGLQRCGKSCRLRWINYLRPDLKRGAFSPQEEELIIHLHTILGNRWSQIAARLPGRTDNEIKNFWNSTLKKRLKINNTSTSSPNDSDSSEPRDHAIGNIMPTHDPDTMTLCMDSSSSSSISMQGMITSNRFDSFSMLNNRYDVTGAASLFDMSTCLTQVGMGDGFYGDHYGILEANNKTGLESDLSLPPLESRSFEE

SEQ ID NO: 50610 - protein, 327 aa, Populus balsamifera subsp. trichocarpa
  misc_feature: Useful for making plants with altered cell wall content and/or composition
  misc_feature: Useful for making plants with altered lignin content
MRKPDLMARDRVPINNNMNRAKLRKGLWSPEEDEKLIQYMLTNGQGCWSEIARNAGLQRCGKSCRLRWINYLRPDLKRGAFSPQEEELIIHLHSILGNRWSQIAARLPGRTDNEIKNFWNSTLKKRFKINSTSTSSPNDSSDSSEPRDHVVGNIMPMHDHDVMTLCKDSSSSPSISMHGVVTGNQFDPFTVLSNRYDVSGAASLFDMSTCLTQVGMGDGFYGDHYGILEGNNKIGLESDLSLPPLESRSIEENNAVSNNRIGVKSSSNDNHHFDSTCFNNTDQRFKVEDMLGLENHWQGENVRMGEWDLEGLMENISSFPFLDFQVL

SEQ ID NO: 50611 - protein, 159 aa, Arabidopsis thaliana
  misc_feature: Useful for making plants with altered lignin content
  misc_feature: Useful for making plants with modulated biomass
MGKARTVGVGMDYSPTSKLALRWAAENLLEDGDTVILIHVQPQNADHTRKILFEETGSPLIPLEEFREVNLSKQYGLAYDPEVLDVLDTLSRAKKVKVVAKVYWGDPREKLCDAVENLKLDSIVLGSRGLGSLKRILLGSVSNHVVTNATCPVTVVKAN

SEQ ID NO: 50612 - protein, 201 aa, Arabidopsis thaliana
  misc_feature: Useful for making plants with altered alkaloid content
MGKARTVGVGMDYSPTSKLALRWAAENLLEDGDTVILIHVQPQNADHTRKILFEETGSPLIPLEEFREVNLSKQYGLAYDPEVLDVLDTLSRAKKVKVVAKVYWGDPREKLCDAVENLKLDSIVLGSRGLGSLKRPNHNGFMIIMFDHSLVGLVSLDHDQSGLINMAEMGSSKSICWIRRNQERDSRWSFSDLLLDDHPLD

SEQ ID NO: 50613 - protein, 379 aa, Arabidopsis thaliana; identical to SEQ ID NO: 9608
  misc_feature: Useful for making plants with altered lignin content

SEQ ID NO: 50614 - protein, 52 aa, Arabidopsis thaliana
  misc_feature: Useful for making plants with modulated salt sensitivity
MASTKPTDQIKQLKDIFARFDMDKDGSLTQLELAALLRSLGIKPRGDQISLL

SEQ ID NO: 50615 - protein, 483 aa, Glycine max; identical to SEQ ID NO: 9651
  misc_feature: Useful for making plants with modulated biomass

SEQ ID NO: 50616 - protein, 41 aa, Arabidopsis thaliana
  misc_feature: Useful for making plants with altered cell wall content and/or composition
MDNFEWEHGYTARFGLYYVDFVNGLKRYPKDSVKWFKRFLK

SEQ ID NO: 50617 - protein, 215 aa, Zea mays; identical to SEQ ID NO: 9499
  misc_feature: Useful for making plants with modulated nitrogen use efficiency

SEQ ID NO: 50618 - protein, 147 aa, Brassica napus
  misc_feature: Useful for making plants with modulated nitrogen use efficiency
MPHGTLEVVLVSAKGLEDSDFLNSMDPYVLLTCRTQDQKSNVASGQGTTPEWNETFIFNVSEGTTELKAKIFDTDVGTEDDPLGEATIPLEAVFLEGDIPPAAYNVVKDEEFKGEIWIALSFKPSENRSRGFEEESYGGWKNSEASY

SEQ ID NO: 50619 - protein, 222 aa, Zea mays
  misc_feature: Useful for making plants with altered lignin content
  misc_feature (134)..(134): Xaa is any aa, unknown, or other
  misc_feature (138)..(138): Xaa is any aa, unknown, or other
  misc_feature (144)..(144): Xaa is any aa, unknown, or other
  misc_feature (146)..(146): Xaa is any aa, unknown, or other
MANVLLRSSSLPLALVPPPLLLLLVAGSLAGATALGSFPGERRGRSLQQLPNPMPQPVPQPQPDPNVRPQPGSPNPLPPQPLPQPNPNPQPQPLPQPQPGPQPDPNPQPQPQPQPLPQPQPGPIPPQPDPNRNXQPQXQPLPQXLXQPQPGPIPQPNPNPNPQPVPMPDPNVQQPQPQPAPNQNPQPQSDQLSGGPQPLPNSEPRMLNPQYAMLLSFAALLL

SEQ ID NO: 50620 - protein, 156 aa, Panicum virgatum
  misc_feature: Useful for making plants with altered carbohydrate content
MAAANGSGGKGFEVPKVEVRFTKLFINGQFVDAVSGKTFETRDPRTGEVIANIAEGDKADVDLAVKAAREAFDNGPWPRMSGYERGRILYKFADLIDQHVEELAMLDTVDAGKLFLVGKVWDIPGAAHLLRYYAGAADKIHGETLKMAQRMHGYTL

SEQ ID NO: 50621 - protein, 164 aa, Arabidopsis thaliana; identical to SEQ ID NO: 9683
  misc_feature: Useful for biocontainment applications
  misc_feature: Useful for making plants with modulated biomass

SEQ ID NO: 50622 - protein, 465 aa, Panicum virgatum; identical to SEQ ID NO: 28214
  misc_feature: Useful for making plants with altered carbohydrate content

SEQ ID NO: 50623 - protein, 436 aa, Arabidopsis thaliana
  misc_feature: Useful for making plants with altered cell wall content and/or composition
MDDLSKLLFFLLLTISITTALPDKPGSGQINSNSVLVALLDSHYTELAELVEKALLLQTLEEAVGQHNITIFAPRNDALEKNLDPEFKSFLLQPKNLKSLQSLLMFHILPKRITSPQFSSAVVSHRTLSNDHLHFTNGKVNSAEITKPDDLTRPDGIIHGIERLLIPRSVQEDFNRRRSLRSIAAVLPEGAPEVDPRTHRLKKKPAPIPAGAPPVLPVYDAMSPGPSLAPAPAPGPGGPRHHFNGEAQVKDFIHTLLHYGGYNEMADILVNLTSLATEMGRLVSEGYVLTVLAPNDEAMAKLTTDQLSEPGAPEQIMYYHIIPEYQTEESMYNSVRRFGKIRYDSLRFPHKVEAQEADGSVKFGHGDGSAYLFDPDIYTDGRISVQGIDGVLFPEEKTPVEKKTGVPVVKKAPKPRRGKLMEVACTMLGSQFPTCQ

SEQ ID NO: 50624 - protein, 415 aa, Panicum virgatum; identical to SEQ ID NO: 2974
  misc_feature: Useful for making plants with altered carbohydrate content

SEQ ID NO: 50625 - protein, 412 aa, Arabidopsis thaliana
  misc_feature: Useful for making plants with altered cell wall content and/or composition
MKIHSCLSAILLFLFFSASSAKQNVRTERISGSAGDVLEDDPVGKLKVYVYELPSKYNKKLLQKDPRCLTHMFAAEIFMHRFLLSSPVRTRNPDEADWFYTPIYPTCDLTPTGLPLPFKSPRMMRSSIQLISSNWPYWNRTEGADHFFVVPHDFGACFHYQEEKAIERGILPLLQRATLVQTFGQRNHVCLDEGSITIPPFAPPQKMQAHFIPPDIPRSIFVYFRGLFYDVNNDPEGGYYARGARAAVWENFKNNPLFDISTDHPTTYYEDMQRAIFCLCPLGWAPWSPRLVEAVVFGCIPVIIADDIVLPFADAIPWEEIGVFVAEKDVPELDTILTSIPTEVILRKQRLLANPSMKRAMLFPQPAQPGDAFHQILNGLARKLPHDKSIYLKTGEKALNWTAGPVADLKPW

SEQ ID NO: 50626 - protein, 500 aa, Arabidopsis thaliana
  misc_feature: Useful for making plants with modulated nitrogen use efficiency
MEGQTLIFTFLFISLSLTFIIGRIKRRPNLPPSPSWALPVIGHLRLLKPPLHRVFLSVSESLGDAPIISLRLGNRLVFVVSSHSLAEECFTKNDVVLANRFNSLASKHISYGCTTVVTASYGDHWRNLRRIGAVEIFSAHRLNSFSSIRRDEIHRLIACLSRNSSLEFTKVEMKSMFSNLTFNNIIRMLAGKCYYGDGAEDDPEAKRVRELIAEGMGCFGAGNTADYLPILTWITGSEKRIKKIASRLDEFLQGLVDERREGKEKRQNTMVDHLLCLQETQPEYYTDNIIKGIMLSLILAGTDTSAVTLEWTLSALLNHPQILSKARDEIDNKVGLNRLVEESDLSHLPYLQNIVSESLRLYPASPLLVPHVASEDCKVGGYHMPRGTMLLTNAWAIHRDPKIWDDPTSFKPERFEKEGEAQKLLGFGLGRRACPGSGLAQRLASLTIGSLIQCFEWERIGEEEVDMTEGGGGVIMPKAIPLVAMCKARPVVGKILNESA

SEQ ID NO: 50627 - protein, 464 aa, Panicum virgatum; identical to SEQ ID NO: 15568
  misc_feature: Useful for making plants with altered carbohydrate content

SEQ ID NO: 50628 - protein, 261 aa, Arabidopsis thaliana; identical to SEQ ID NO: 9600
  misc_feature: Useful for making plants with altered lignin content

SEQ ID NO: 50629 - protein, 87 aa, Arabidopsis thaliana
  misc_feature: Useful for making plants with modulated nitrogen use efficiency
MSGNSEGLLESSGGGVGGSVEEEKDMKMEETGEGAGSGGNRWPRPETLALLRIRSEMDKAFRDSTLKAPLWEEISRFVIFCYMHIYL

SEQ ID NO: 50630 - protein, 202 aa, Arabidopsis thaliana; identical to SEQ ID NO: 9286
  misc_feature: Useful for making plants with altered lignin content

SEQ ID NO: 50631 - protein, 58 aa, Panicum virgatum; identical to SEQ ID NO: 6434
  misc_feature: Useful for making plants with altered carbohydrate content

SEQ ID NO: 50632 - protein, 302 aa, Arabidopsis thaliana
  misc_feature: Useful for biocontainment applications
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPPPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 50633 - protein, 645 aa, Arabidopsis thaliana
  misc_feature: Useful for making plants with modulated light response
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQNLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 50634 - protein, 608 aa, Arabidopsis thaliana
  misc_feature: Useful for making plants with modulated flowering time
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 50635 - protein, 552 aa, Arabidopsis thaliana
  misc_feature: Useful for making plants with modulated light quality sensitivity
MKESDLTTEPIAQNLIKLISNVCFSVFVFTVLIFTVIAVTYQPPDPWLESAPALTKLLTETENATFKIDGSILKTGEDLASSPSSSPPSNSTEQVTEATIEKSEAKIGNMTVKNSIDCDEDLKIVNCSDPRVLVAVERFNLKVFKSIVFLEYETPVNGSKLDECDVSWRFRNKKEKSWRRYRDFRRFRFGFGENCTYKVFHTSGWHSGVNARRPRISRPSSSRGARGGDSEINDTIPTLGSQTSFRRGKYLYYSRGGDYCKGMNQYMWSFLCGLGEAMYLNRTFVMDLSLCLSSSYSSKGKDEEGKDFRYYFDFEHLKETASIVEEGEFLRDWKKWNRLHKRKVPVRKVKTHRVSPLQLSKDKSTIIWRQFDTPEPENYWYRVCEGQASKYVERPWHALWKSKRLMNIVSEISGKMDWDFDAVHVVRGEKAKNKKLWPHLDADTWPDAILTKLKGLVQVWRNLYVATNEPFYNYFDKLRSQYKVHLLDDYSYLWGNKSEWYNETSLLNNGKPVEFDGYMRVAVDTEVFYRGKTRVETFYNLTTDCKDGINTC

SEQ ID NO: 50636 - protein, 425 aa, Panicum virgatum; identical to SEQ ID NO: 15840
  misc_feature: Useful for making plants with altered carbohydrate content

SEQ ID NO: 50637 - protein, 227 aa, Arabidopsis thaliana; identical to SEQ ID NO: 9501
  misc_feature: Useful for biocontainment applications

SEQ ID NO: 50638 - protein, 104 aa, Glycine max
  misc_feature: Useful for making plants with modulated nitrogen use efficiency
  misc_feature (82)..(82): Xaa is any aa, unknown, or other
  misc_feature (83)..(83): Xaa is any aa, unknown, or other
  misc_feature (84)..(84): Xaa is any aa, unknown, or other
MGRQPCCDKVGLKKGPWTAEEDKKLINFILTNGQCCWRAVPKLAGLLRCGKSCRLRWTNYLRPDLKERPSIRIMKRKWSLIXXXNLAIDGLRLLLISQEELIMR

SEQ ID NO: 50639 - protein, 315 aa, Arabidopsis thaliana; identical to SEQ ID NO: 9531
  misc_feature: Useful for making plants with altered terpenoid content

SEQ ID NO: 50640 - protein, 318 aa, Arabidopsis thaliana
  misc_feature: Useful for making plants with altered lignin content
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKYGIDNLPKTAKNECVISRVFHKRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 50641 - protein, 197 aa, Panicum virgatum
  misc_feature: Useful for making plants with altered carbohydrate content
MHPSGGPLSVPPGFRFHPTDEELLYYYLRKKVAYEPIDLDVIREIDLNKLEPWDLKDRCRIGTGPQNDWYFFSHKDKKYPTGTRTNRATTAGFWKATGRDKAIFLGNARRIGLRKTLVFYIGRAPHGKKTDWIMHEYRLDEENVEIQEDGWVVCRVFKKKNYQRGLNPAEMAELDDDELQPFPVPVPGALPIDHKHN

SEQ ID NO: 50642 - protein, 394 aa, Arabidopsis thaliana
  misc_feature: Useful for biocontainment applications
MNSFSQVPPGFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 50643 - protein, 470 aa, Arabidopsis thaliana
  misc_feature: Useful for making plants with altered cell wall content and/or composition
MASSSQKLISVCVAVLVVLALTAMIFRNSEISLSRKLKTEVIQSSNSSTMAAIRKLKTEEFQSLNSSTMAATRLDGEPQQQQHAVADDPDMVADEVAKLVQMSEQNRTARRKLGFFSCGTGNPIDDCWRCDRNWHKNRKRLADCGIGFGRNAIGGRDGRFYIVTDPTDEDVVNPKPGTLRHAVIQEEPLWIVFKRDMVIELKQELIMNSFKTIDARGSNVHIANGACITIQFITNVIIHGLHIHDCKPTGNAMVRSSPSHFGWRTMADGDAVSIFGSSHIWIDHNSLSHCADGLVDAVMGSTAITVSNNHFTHHNEVMLLGHSDSYTKDKLMQVTIAYNHFGEGLVQRMPRCRHGYFHVVNNDYTHWEMYAIGGSAEPTINSQGNRYAAPMDRFAKEVTKRVETDASEWKKWNWRSEGDLLLNGAFFRPSGAGASASYGRASSLAAKPSSMVDTITSTAGALGCRKGRPC

SEQ ID NO: 50644 - protein, 408 aa, Arabidopsis thaliana
  misc_feature: Useful for making plants with altered cell wall content and/or composition
  misc_feature: Useful for making plants with modulated phosphate use efficiency
MKMQTKKLFITIVSFLLYAPLFLSSPVPDPESVVEEVHKSINASVAGRRKLGYLSCTTGNPIDDCWRCDPHWEQHRQRLADCAIGFGKNAIGGRDGRIYVVTDSGNDNPVSPKPGTLRHAVVQDEPLWIIFQRDMTIQLKEELIMNSFKTIDGRGASVHISGGPCITIQYVTNIIIHGIHIHDCKQGGNAMVRSSPRHFGWRTISDGDGVSIFGGSHVWVDHCSFSNCEDGLIDAIMGSTAITLSNNHMTHHDKVMLLGHSDTYSRDKNMQVTIAFNHFGEGLVQRMPRCRHGYFHVVNNDYTHWEMYAIGGSANPTINSQGNRFLAPNIRFSKEVTKHEDAPESEWKRWNWRSSGDLLLNGAFFTPSGGAASSSYAKASSLGAKPSSLVGPLTSTSGALNCRKGSRC

SEQ ID NO: 50645 - protein, 428 aa, Panicum virgatum; identical to SEQ ID NO: 27145
  misc_feature: Useful for making plants with altered carbohydrate content

SEQ ID NO: 50646 - protein, 364 aa, Panicum virgatum; identical to SEQ ID NO: 260
  misc_feature: Useful for making plants with altered carbohydrate content

SEQ ID NO: 50647 - protein, 344 aa, Arabidopsis thaliana
  misc_feature: Useful for making plants with altered cell wall content and/or composition
  misc_feature: Useful for making plants with altered lignin content
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLEFTSTKQSLYDTVKSLQEKGHLAPPPPPPSASQESVENGIKIGS

SEQ ID NO: 50648 - protein, 453 aa, Arabidopsis thaliana; identical to SEQ ID NO: 9428
  misc_feature: Useful for making plants with modulated drought sensitivity

SEQ ID NO: 50649 - protein, 329 aa, Arabidopsis thaliana
  misc_feature: Useful for making plants with modulated water use efficiency
IRSWFQISLFSSKTHLSLSLIKHKNSFIVLSRLTYNTRLSNRNRFSLFDQISDLSLFDSSSLDRFSLETTMASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 50650 - protein, 303 aa, Arabidopsis thaliana; identical to SEQ ID NO: 9366
  misc_feature: Useful for making plants with altered protein content

SEQ ID NO: 50651 - protein, 327 aa, Panicum virgatum; identical to SEQ ID NO: 5490
  misc_feature: Useful for making plants with altered carbohydrate content

SEQ ID NO: 50652 - protein, 321 aa, Arabidopsis thaliana
  misc_feature: Useful for making plants with altered cell wall content and/or composition
MAVVQKGKVCVTGAGGFLGSWVVNHLLSRDYFVHGTVRDPGNEKYAHLKKLDKAGDKLKLFKADLLNYGSLQSAIAGCSGVFHVACPVPSASVPNPEVDLIAPAVDGTLNVLKACVEAKVKRVVYVSSVSAVAMNPMWSKSQVLDETAWSDQDYCKKTENWYSLSKTRAESEAFEFAKRTGLDLVSVCPTLVLGPVLQQHTVNASSLVLLKLLKEGYESRNNQERHLVDVRDVAQALLLVYEKAEAEGRYICIGHTVREQEVAEKLKSLYLNYNYPKRYIEADGKVKVSSEKLQKLGWTYRPLEETLVDSVESYRKAKLVD

SEQ ID NO: 50653 - protein, 321 aa, Arabidopsis thaliana; identical to SEQ ID NO: 9628
  misc_feature: Useful for making plants with altered cell wall content and/or composition
  misc_feature: Useful for making plants with altered lignin content

SEQ ID NO: 50654 - protein, 672 aa, Panicum virgatum; identical to SEQ ID NO: 29916
  misc_feature: Useful for making plants with altered carbohydrate content

SEQ ID NO: 50655 - protein, 656 aa, Arabidopsis thaliana
  misc_feature: Useful for making plants with altered cell wall content and/or composition
MSSLICFIFLFLFSFITSFTASAQNPFYLYHNCSITTTYSSNSTYSTNLKTLLSSLSSRNASYSTGFQNATAGQAPDMVTGLFLCRGNVSPEVCRSCIALSVNESLSRCPNEREAVFYYEQCMLRYSNRNILSTLNTDGGVFMQNARNPISVKQDRFRDLVLNPMNLAAIEAARSIKRFAVTKFDLNALQSLYGMVQCTPDLTEQDCLDCLQQSINQVTYDKIGGRTFLPSCTSRYDNYEFYNEFNVGKGGNSSVIVIAVVVPITVLFLLFVAFFSVRRAKRKKTIGAIPLFKVKRKETEVTEPPAETTDGDDITTAGSLQFDFKAIVAATDIFLPINKLGQGGFGEVYKGTFPSGVQVAVKRLSKNSGQGEKEFENEVVVVAKLQHRNLVKLLGYCLEGEEKILVYEFVPNKSLDYFLFDPTMQGQLDWSRRYKIIGGIARGILYLHQDSRLTIIHRDLKAGNILLDADMNPKVADFGMARIFGMDQTEANTRRVVGTYGYMAPEYAMYGKFSMKSDVYSFGVLVLEIVSGMKNSSLDQMDGSISNLVTYTWRLWSNGSPSELVDPSFGDNYQTSEITRCIHIALLCVQEDANDRPTMSAIVQMLTTSSIALAVPRPPGFFLRSKQEQAERACPSMDTSDLFSIDEASITSVAPR

SEQ ID NO: 50656 - protein, 351 aa, Panicum virgatum; identical to SEQ ID NO: 21700
  misc_feature: Useful for making plants with altered carbohydrate content

SEQ ID NO: 50657 - protein, 121 aa, Arabidopsis thaliana; identical to SEQ ID NO: 9241
  misc_feature: Useful for making plants with altered protein content

SEQ ID NO: 50658 - protein, 439 aa, Arabidopsis thaliana
  misc_feature: Useful for making plants with modulated light quality response
MDSREIHHQQQQQQQQQQQQQQQQQHLQQQQQPPPGMLMSHHNSYNRNPNAAAAVLMGHNTSTSQAMHQRLPFGGSMSPHQPQQHQYHHPQPQQQIDQKTLESLGFDGSPSSVAATQQHSMRFGIDHQQVKKKRGRPRKYAADGGGGGGGGSNIALGLAPTSPLPSASNSYGGGNEGGGGGDSAGANANSSDPPAKRNRGRPPGSGKKQLDALGGTGGVGFTPHVIEVKTGEDIATKILAFTNQGPRAICILSATGAVTNVMLRQANNSNPTGTVKYEGRFEIISLSGSFLNSESNGTVTKTGNLSVSLAGHEGRIVGGCVDGMLVAGSQVQVIVGSFVPDGRKQKQSAGRAQNTPEPASAPANMLSFGGVGGPGSPRSQGQQHSSESSEENESNSPLHRRSNNNNSNNHGIFGNSTPQPLHQIPMQMYQNLWPGNSPQ

SEQ ID NO: 50659 - protein, 495 aa, Panicum virgatum; identical to SEQ ID NO: 3582
  misc_feature: Useful for making plants with altered carbohydrate content

SEQ ID NO: 50660 - protein, 172 aa, Arabidopsis thaliana
  misc_feature: Useful for making plants with altered alkaloid content
  misc_feature: Useful for making plants with altered lignin content
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSQEKER

SEQ ID NO: 50661 - protein, 352 aa, Arabidopsis thaliana
  misc_feature: Useful for making plants with altered lignin content
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSNKQAIINAL

SEQ ID NO: 50662 - protein, 384 aa, Glycine max; identical to SEQ ID NO: 9654
  misc_feature: Useful for making plants with altered alkaloid content
  misc_feature: Useful for making plants with altered lignin content

SEQ ID NO: 50663 - protein, 399 aa, Capsicum annuum
  misc_feature: Useful for making plants with modulated water use efficiency
MEGTSSIDQESTTSDSLSIAPAASSSMVVKQQPSMTTTKPPESLCRMGSGTSSVIIDGENGVEAESRKLPSSKYKGVVPQPNGRWGAQIYEKHQRVWLGTFNEENEAARAYDVAAQRFRGRDAVTNFKPLLENQESDDDVEIAFLNSHSKAEIVDMLRKHTYIDELEQSKKLFGYTKDGTMAKNKDGLIDISSFFGGGGTIDKVNNKVREQLFEKAVTPSDVGKLNRLVIPKQHAEKHFPLQNGNNSKGVLLNFEDLNGKVWRFRYSYWNSSQSYVLTKGWSRFVKEKNLKAGDIVSFQRSTSGDKQLYIDFKARNMAPTNPVVTNQVQAQVQVPRVQMMRLFGVNICKIPATINNVVDNNNNNNNNMANCSGGKRMMEMELLTFESCRKKQRVIIDAL

SEQ ID NO: 50664 - protein, 361 aa, Arabidopsis thaliana; identical to SEQ ID NO: 9247
  misc_feature: Useful for making plants with altered lignin content
  misc_feature: Useful for making plants with altered protein content
  misc_feature: Useful for making plants with altered terpenoid content

SEQ ID NO: 50665 - protein, 299 aa, Arabidopsis thaliana
  misc_feature: Useful for biocontainment applications
  misc_feature: Useful for making plants with modulated biomass
  misc_feature: Useful for making plants with modulated flowering time
  misc_feature: Useful for making plants with modulated time to senescence
MNQEDKEKPIEEASSSMEREHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQRDSCNKDKLYIDWRRRPKIPDHHHQQFAGAMFPRFYTFPHPQMPTNYETHNLYHRFHQRDLGIGYYVRSMERSHPTAVIESVPVIMQRRAQVASMASRGEKRLRLFGVDMECGGGGGSVNSTEEESSSSGGSMPRGRVSMVGAGSLLQLRLVSSDDESLVAMEAASLEDHHFFTKKGKSSLSFDLDR

SEQ ID NO: 50666 - protein, 498 aa, Panicum virgatum; identical to SEQ ID NO: 16169
  misc_feature: Useful for making plants with altered carbohydrate content

SEQ ID NO: 50667 - protein, 506 aa, Arabidopsis thaliana
  misc_feature: Useful for making plants with altered cell wall content and/or composition
MVENLFPSRFQFHLQRLDPKRRLTSLLASHKTLFTFLWITAFGSVFLWQRTAYIEGGSGTGPVGGKFTIFGKIKPIQPIPRLRPVVFDLKDFGGVGDGFTLNTEAFERAVISISKLGGSSGGGQLNVPPGRWLTAPFNLTSHMTLFLAEDSEILGVEDEKYWPLMPPLPSYGYGRERPGPRYGSLIHGQNLKDIVITGHNGTINGQGQSWWKKHQRRLLNYTRGPLVQIMWSSDIVIANITMRDSPFWTLHPYDCKNVTIRNVTILAPVTGAPNTDGIDPDSCEDMVIEDCYISTGDDAIAIKSGWDQFGIAYGRPSTNILIRNLVVRSVISAGVSIGSEMSGGISNVTIENLLIWNSRRGIRIKTAPGRGGYIRNITYKNLTLDNVRVGIVIKTDYNEHADDNYDRKAYPILSGFSFAGIHGQGVRVPVRIHGSEQIPVRNVTFRDMSVGLTYKKKHIFQCSFVKGRVFGSIFPRPCENFDVYDEEGRLVKPAAESNVADIDYDI

SEQ ID NO: 50668 - protein, 454 aa, Zea mays; identical to SEQ ID NO: 9238
  misc_feature: Useful for making plants with altered oil content

SEQ ID NO: 50669 - protein, 390 aa, Panicum virgatum; identical to SEQ ID NO: 16201
  misc_feature: Useful for making plants with altered carbohydrate content

SEQ ID NO: 50670 - protein, 389 aa, Arabidopsis thaliana; identical to SEQ ID NO: 9632
  misc_feature: Useful for making plants with altered cell wall content and/or composition
  misc_feature: Useful for making plants with altered lignin content

SEQ ID NO: 50671 - protein, 287 aa, Arabidopsis thaliana
  misc_feature: Useful for making plants with modulated biomass
MSQTSYYRSPFGDTTYTKVFVGGLAWETPTDEMRRYFEQFGEILEAVIITDKNTGKSKGYGFVTFRESDSATRAVADPNPVIDGRKANCNIASFGRPRPSPPRGRGQTGSPSQYQSGGPSTYTGMAAPLPPAAAPQLMYPSYGYTYNPDQFGYHQALYNTQLQQAQYYQQQQQLYGGGATSPSSSGATIMPSPYYYGYSLQAPRVPYQHHHHLPQPYNPQQHHHQRFSSPSFLVYPSNSSFAPPLQGVLSSSTESEAVPQQVPAAEGEATTTAPEITTSNTKEPISS

SEQ ID NO: 50672 - protein, 522 aa, Arabidopsis thaliana
  misc_feature: Useful for biocontainment applications
  misc_feature: Useful for making plants with modulated biomass
MKTQHQWWEVLDPFLTQHEALIAFLTFAAVVIVIYLYRPSWSVCNVPGPTAMPLVGHLPLMAKYGPDVFSVLAKQYGPIFRFQMGRQPLIIIAEAELCREVGIKKFKDLPNRSIPSPISASPLHKKGLFFTRDKRWSKMRNTILSLYQPSHLTSLIPTMHSFITSATHNLDSKPRDIVFSNLFLKLTTDIIGQAAFGVDFGLSGKKPIKDVEVTDFINQHVYSTTQLKMDLSGSLSIILGLLIPILQEPFRQVLKRIPGTMDWRVEKTNARLSGQLNEIVSKRAKEAETDSKDFLSLILKARESDPFAKNIFTSDYISAVTYEHLLAGSATTAFTLSSVLYLVSGHLDVEKRLLQEIDGFGNRDLIPTAHDLQHKFPYLDQVIKEAMRFYMVSPLVARETAKEVEIGGYLLPKGTWVWLALGVLAKDPKNFPEPEKFKPERFDPNGEEEKHRHPYAFIPFGIGPRACVGQRFALQEIKLTLLHLYRNYIFRHSLEMEIPLQLDYGIILSFKNGVKLRTIKRF

SEQ ID NO: 50673 - protein, 572 aa, Arabidopsis thaliana; identical to SEQ ID NO: 9742
  misc_feature: Useful for making plants with modulated biomass

SEQ ID NO: 50674 - protein, 486 aa, Panicum virgatum; identical to SEQ ID NO: 16281
  misc_feature: Useful for making plants with altered carbohydrate content

SEQ ID NO: 50675 - protein, 460 aa, Arabidopsis thaliana
  misc_feature: Useful for making plants with altered cell wall content and/or composition
MPLSATADTSKTVKLERYNSYLRKIHSTKVLNASSKVLFRATLLVALVLVLIFAINYPPLSDSRAAAAHHLHRRSFLSTGLFSSSSSSSSIGGAAWEKRVRQSSTAKRPHGLSVLVTGAAGFVGSHCSLALRKRGDGVLGFDNFNDYYDPSLKRARQELLEKQQVFIVEGDLNDGPLLRKLFDVVPFTHILHLAAQAGVRYAMKNPQSYIASNIAGFVNLLEVAKAANPQPAIVWASSSSVYGLNTENPFSEEHRTDQPASLYAATKKAGEEIAHTYNHIYGLSLTGLRFFTVYGPWGRPDMAYFFFTKDILHGKSIDIYRTQDNQEVARDFTYIDDIVKGCVGALDTAEKSTGSGGKKRGQAQLRVYNLGNTSPVPVGRLVSILEGLLGTKAKKHLIKMPRNGDVPYTHANVSLAYKDFGYKPTTDLAAGLRKFVKWYVGYYGIQPRVKKETSHAEDSA

SEQ ID NO: 50676 - protein, 425 aa, Panicum virgatum; identical to SEQ ID NO: 16283
  misc_feature: Useful for making plants with altered carbohydrate content

SEQ ID NO: 50677 - protein, 457 aa, Panicum virgatum; identical to SEQ ID NO: 708
  misc_feature: Useful for making plants with altered carbohydrate content

SEQ ID NO: 50678 - protein, 175 aa, Panicum virgatum
  misc_feature: Useful for making plants with altered carbohydrate content
MPRMVVIPPGMDFSNVFPEDIDGDGDGKDDIISLEGASPKSMPPIWAEVMRFLTNPHKPMILALSRPDPKKNITTLVKAFGECRPLRELANLTLIMGNRDDIDEMSAGNASVLTTVLKLIDKYDLYGSVAFPKHHNQADVPEIYRLAAKMKGVFIHPALVESFWPPLDRGCGTRT

SEQ ID NO: 50679 - protein, 1062 aa, Arabidopsis thaliana
  misc_feature: Useful for making plants with altered cell wall content and/or composition
MAGNEWINGYLEAILDSQAQGIEETQQKPQASVNLREGDGQYFNPTKYFVEEVVTGVDETDLHRTWLKVVATRNSRERNSRLENMCWRIWHLTRKKKQLEWEDSQRIANRRLEREQGRRDATEDLSEDLSEGEKGDGLGEIVQPETPRRQLQRNLSNLEIWSDDKKENRLYVVLISLHGLVRGENMELGSDSDTGGQVKYVVELARALARMPGVYRVDLFTRQICSSEVDWSYAEPTEMLTTAEDCDGDETGESSGAYIIRIPFGPRDKYLNKEILWPFVQEFVDGALAHILNMSKVLGEQIGKGKPVWPYVIHGHYADAGDSAALLSGALNVPMVLTGHSLGRNKLEQLLKQGRQSKEDINSTYKIKRRIEAEELSLDAAELVITSTRQEIDEQWGLYDGFDVKLEKVLRARARRGVNCHGRFMPRMAVIPPGMDFTNVEVQEDTPEGDGDLASLVGGTEGSSPKAVPTIWSEVMRFFTNPHKPMILALSRPDPKKNITTLLKAFGECRPLRELANLTLIMGNRDDIDELSSGNASVLTTVLKLIDKYDLYGSVAYPKHHKQSDVPDIYRLAANTKGVFINPALVEPFGLTLIEAAAHGLPMVATKNGGPVDIHRALHNGLLVDPHDQEAIANALLKLVSEKNLWHECRINGWKNIHLFSWPEHCRTYLTRIAACRMRHPQWQTDADEVAAQDDEFSLNDSLKDVQDMSLRLSMDGDKPSLNGSLEPNSADPVKQIMSRMRTPEIKSKPELQGKKQSDNLGSKYPVLRRRERLVVLAVDCYDNEGAPDEKAMVPMIQNIIKAVRSDPQMAKNSGFAISTSMPLDELTRFLKSAKIQVSEFDTLICSSGSEVYYPGGEEGKLLPDPDYSSHIDYRWGMEGLKNTVWKLMNTTAVGGEARNKGSPSLIQEDQASSNSHCVAYMIKDRSKVMRVDDLRQKLRLRGLRCHPMYCRNSTRMQIVPLLASRSQALRYLFVRWRLNVANMYVVVGDRGDTDYEELISGTHKTVIVKGLVTLGSDALLRSTDLRDDIVPSESPFIGFLKVDSPVKEITDIFKQLSKATA

SEQ ID NO: 50680 - protein, 1043 aa, Arabidopsis thaliana
  misc_feature: Useful for making plants with altered cell wall content and/or composition
  misc_feature: Useful for making plants with modulated biomass
  misc_feature: Useful for making plants with modulated carbohydrate content
MAGNDWVNSYLEAILDVGQGLDDARSSPSLLLRERGRFTPSRYFVEEVITGYDETDLHRSWVKAVATRSPQERNTRLENMCWRIWNLARQKKQHEEKEAQRLAKRRLEREKGRREATADMSEEFSEGEKGDIISDISTHGESTKPRLPRINSAESMELWASQQKGNKLYLVLISLHGLIRGENMELGRDSDTGGQVKYVVELARALGSMPGVYRVDLLTRQVSSPDVDYSYGEPTEMLTPRDSEDFSDEMGESSGAYIVRIPFGPKDKYIPKELLWPHIPEFVDGAMSHIMQMSNVLGEQVGVGKPIWPSAIHGHYADAGDATALLSGALNVPMLLTGHSLGRDKLEQLLRQGRLSKEEINSTYKIMRRIEGEELSLDVSEMVITSTRQEIDEQWRLYDGFDPILERKLRARIKRNVSCYGRFMPRMVKIPPGMEFNHIVPHGGDMEDTDGNEEHPTSPDPPIWAEIMRFFSNSRKPMILALARPDPKKNITTLVKAFGECRPLRELANLALIMGNRDGIDEMSSTSSSVLLSVLKLIDKYDLYGQVAYPKHHKQSDVPDIYRLAAKSKGVFINPAIIEPFGLTLIEAAAHGLPMVATKNGGPVDIHRVLDNGLLVDPHDQQSISEALLKLVADKHLWAKCRQNGLKNIHQFSWPEHCKTYLSRITSFKPRHPQWQSDDGGDNSEPESPSDSLRDIQDISLNLKFSFDGSGNDNYMNQEGSSMDRKSKIEAAVQNWSKGKDSRKMGSLERSEVNSGKFPAVRRRKFIVVIALDFDGEEDTLEATKRILDAVEKERAEGSVGFILSTSLTISEVQSFLVSGGLNPNDFDAFICNSGSDLHYTSLNNEDGPFVVDFYYHSHIEYRWGGEGLRKTLIRWASSLNEKKADNDEQIVTLAEHLSTDYCYTFTVKKPAAVPPVRELRKLLRIQALRCHVVYSQNGTRINVIPVLASRIQALRYLFVRWGIDMAKMAVFVGESGDTDYEGLLGGLHKSVVLKGVSCSACLHANRSYPLTDVISFESNNVVHASPDSDVRDALKKLELLKD

SEQ ID NO: 50681 - protein, 418 aa, Panicum virgatum; identical to SEQ ID NO: 16394
  misc_feature: Useful for making plants with altered carbohydrate content

SEQ ID NO: 50682 - protein, 415 aa, Arabidopsis thaliana
  misc_feature: Useful for making plants with altered cell wall content and/or composition
MKLSSCVLIFLLCNTFSSISAFRLSRSQPTERISGSAGDVLEDDPVGRLKVFVYELPSKYNKKILQKDPRCLNHMFAAEIYMQRFLLSSPVRTLNPEEADWFYVPVYTTCDLTPNGLPLPFKSPRMMRSAIQLIASNWPYWNRTEGADHFFVVPHDFGACFHYQEEKAIGRGILPLLQRATLVQTFGQRNHVCLKEGSITVPPYAPPQKMQSHLIPEKTPRSIFVYFRGLFYDVGNDPEGGYYARGARAAVWENFKDNPLFDISTEHPTTYYEDMQRAIFCLCPLGWAPWSPRLVEAVIFGCIPVIIADDIVLPFADAIPWEDIGVFVDEKDVPYLDTILTSIPPEVILRKQRLLANPSMKQAMLFPQPAQPGDAFHQVLNGLARKLPHERSVYLRPGEKLLNWTAGPVADLKPW

SEQ ID NO: 50683 - protein, 269 aa, Zea mays; identical to SEQ ID NO: 9441
  misc_feature: Useful for making plants with altered lignin content

SEQ ID NO: 50684 - protein, 259 aa, Arabidopsis thaliana
  misc_feature: Useful for making plants with altered alkaloid content
MASQVRSVKVGNLSSGATEHDIKEFFSFSGEVESIDIQSNEHSAYVTFKETQGAETAVLLSGASIADQSVIIELAPNYSPPAAPHAETQSSGAESVVQKAEDVVSSMLAKGFILGKDAVGKAKAFDEKHGFTSTATAGVASLDQKIGLSQKLTAGTSLVNEKIKAVDQNFQVTERTKSVYAAAEQTVSSAGSAVMKNRYVLTGVSWAAGAFNRVAQAAGEVGQKTKEKVEAEQPSQPAQSQQQLPEGYSPIHTSEYSKN

SEQ ID NO: 50685 - protein, 190 aa, Zea mays
  misc_feature: Useful for making plants with altered alkaloid content
MIRTATVRARLLLSRSYVAQAKAASRWPLVRWKASHLGSVRSFYQMDITRQYKNKILTARGCHSSPESQELAMKSCVPCNSKDLGPMSEDSAKKLLEQVNGWELITEGGVLKLHRTWKVKNFVKGLEFFQLVAAIAEEEGHHPDLHLVGWNNVKIDVWTHSVRGLTSNDFILAAKINHLTLDGIIRKKAK

SEQ ID NO: 50686 - protein, 112 aa, Arabidopsis thaliana
  misc_feature: Useful for making plants with modulated biomass
MAGISRVLGGFRTLMSKAATVEAVTVAGEGKGIFKTRPVSQQLASFAGERELTRGSALKKVWEYVKLHNLQNPANKKEIHCDDKLKTIFDGKDKVGITEIMKLLSPHFPKSV

SEQ ID NO: 50687 - protein, 247 aa, Zea mays subsp. mays
  misc_feature: Useful for making plants with modulated nitrogen use efficiency
MAAAISLEAGGALAHDLGSAVVTGGVALALLKFFEELAKRGVFEQKLSRKLVHISVGLVFMLFWPLFSSGWYTPFLAALAPGVNIIRMLLLGLGLMKNEAMVKSMSRSGDYRELLKGPLYYAATITFATSLLWRTSPVAIALICNLCAGDGIADVVGRRLGKEKLPYNPNKSYAGSIAMAVAGFLASVGYMHYFHTFGFIEETWYMALSFLVVSVAAALVESHPISTELDDNLTVLLTSFLVGSLIF

SEQ ID NO: 50688 - protein, 225 aa, Glycine max
  misc_feature: Useful for making plants with altered alkaloid content
  misc_feature (131)..(131): Xaa is any aa, unknown, or other
MNLDELLQNVWTAEASKSSVVVGVESENMSSSSSSLQRQASLTLARALSGKTVDDVWREIQQGQKKKYGEDVRSQEGEMTLGETTLEDFLVQAGLFAEASISPAVGLDAMDSLATQGFQQKTGLLSSSPSXGSLSDTRLGRKRDASDAYEKTLERRLRRKIKNRESAARSRARKQAYHNELVGKVSRLEEENVKLKKEKEFEERLLPDPLPERKYQLRRHNSAFF

SEQ ID NO: 50689 - protein, 484 aa, Panicum virgatum; identical to SEQ ID NO: 3748
  misc_feature: Useful for making plants with altered carbohydrate content

SEQ ID NO: 50690 - protein, 499 aa, Arabidopsis thaliana
  misc_feature: Useful for making plants with modulated biomass
MDLLLIIAGLVAAAAFFFLRSTTKKSLRLPPGPKGLPIIGNLHQMEKFNPQHFLFRLSKLYGPIFTMKIGGRRLAVISSAELAKELLKTQDLNFTARPLLKGQQTMSYQGRELGFGQYTAYYREMRKMCMVNLFSPNRVASFRPVREEECQRMMDKIYKAADQSGTVDLSELLLSFTNCVVCRQAFGKRYNEYGTEMKRFIDILYETQALLGTLFFSDLFPYFGFLDNLTGLSARLKKAFKELDTYLQELLDETLDPNRPKQETESFIDLLMQIYKDQPFSIKFTHENVKAMILDIVVPGTDTAAAVVVWAMTYLIKYPEAMKKAQDEVRSVIGDKGYVSEEDIPNLPYLKAVIKESLRLEPVIPILLHRETIADAKIGGYDIPAKTIIQVNAWAVSRDTAAWGDNPNEFIPERFMNEHKGVDFKGQDFELLPFGSGRRMCPAMHLGIAMVEIPFANLLYKFDWSLPKGIKPEDIKMDVMTGLAMHKKEHLVLAPTKHI

SEQ ID NO: 50691 - protein, 503 aa, Arabidopsis thaliana
  misc_feature: Useful for making plants with modulated drought sensitivity
MSNIQEMEMILMVSLCLTTLITLFLLKQFLKRTANKVNLPPSPWRLPLIGNLHQLSLHPHRSLHSLSLRYGPLMLLHFGRVPILVVSSGEAAQEVLKTHDLKFANRPRSKAVHGLMNGGRDVVFGPYGEYWRQMKSVCILNLLTNKMVASFEKIREEELNEMIKKLEKASSSSSSENLSELFVTLPSDVTSRIALGRKHSEDETARDLKKRVRQIMELLGEFPIGDYVPALAWIDRINGFNARIKEVSQGFSDLMDKVVQEHLEAGNHKEDFVDILLSIESEKSIGFQAQRDDIKFMILDMFIGGTSTSSTLLEWIMTELIRNPNVMKKLQDEIRSTIRPHGSYIKEKDVENMKYLKAVIKEVFRVHPPLPLILPRLLSEDVKVKGYNIAAGTEVIINAWAIQRDPAIWGPDAEEFKPERHLDSTLDYHGKDLNFIPFGSGRRICPGINLALGLVEVTVANLVGRFDWRAEAGPNGDQPDLTEAFGLDVCRKFPLIAFPSSVI

SEQ ID NO: 50692 - protein, 413 aa, Panicum virgatum; identical to SEQ ID NO: 17328
  misc_feature: Useful for making plants with altered carbohydrate content

SEQ ID NO: 50693 - protein, 375 aa, Arabidopsis thaliana
  misc_feature: Useful for making plants with altered cell wall content and/or composition
LVVTSPSQLLMVPLTLIQAAASKGAVCLDGTLPGYHLHPGSGSGANRWLIQLEGGGWCNTRRSCIFRKTTRRGSSNHMEKVLAFTGILSNKSNENPDFFNWNRVKLRYCDGASFTGDSQDESSQLYYRGQRIWHSAMEELLSKGMQKAEQALLSGCSAGGLASILHCDQFKELFPGTTTVKCLSDAGMFMDAVDVSGGHSLRKMFQGVVTVQNLQKELSTACTKHLDPTSCFFPQNLVSGIKTPMFLLNAAYDAWQVQESLAPPSVDLSGSWKACKSDHSHCNSSQIQFFQDFRTHMVDAVKSFATSTHNGVFINSCFAHCQSERQDTWYAPDSPTLHGKTVAESVGDWYFDRTTVKAIDCPYPCDKTCHNLIFK

SEQ ID NO: 50694 - protein, 490 aa, Panicum virgatum
  misc_feature: Useful for making plants with altered carbohydrate content
MGLAKVAVGCPRLEKLSVKWCREISDIGIDLLAKKCPELRSLNISYLKVGNESLRSISTLEKLEELAMVGCSCIDDEGLELLSKGSDSLQSVDVSRCDHVTYQGLASLIDGRKFLQKLHAADCLHEIGQCFLSKLATLKETLTVLKLDGLGVSDSLLQAFGEGCNNLVEIGLSKCSGVTDEGISSLVARCSDLKTINLTCCNLITNNALNSIADNCKMLECLLLESCSLINEKGIKQIATCCPNLKEIDLTDCGVNDAALEYLAKCSELRILKLGLCSSISDKGIAFISSNCGKLVELDLYRCNSFTDDGLAALANGCKKIKLLNLCYCNKITDSGLGHLGSLEELTNLELRCLVRITCIGISSIAIGCKSLIELDLKRCYSVDDASLEALARNALNLRQLTISYCQVTGLGLCHLLSSLRCLQDIKMVHLSWVSIEGFEMALRAACGRLKKLKMLTGLKTVLSPELLQMLQACGCRIRWVNKPLVYKDC

SEQ ID NO: 50695 - protein, 464 aa, Panicum virgatum; identical to SEQ ID NO: 16505
  misc_feature: Useful for making plants with altered carbohydrate content

SEQ ID NO: 50696 - protein, 446 aa, Arabidopsis thaliana; identical to SEQ ID NO: 9702
  misc_feature: Useful for making plants with modulated salt sensitivity

SEQ ID NO: 50697 - protein, 495 aa, Arabidopsis thaliana
  misc_feature: Useful for making plants with modulated biomass
  misc_feature: Useful for making plants with modulated heat sensitivity
MFVNFKYFSFFIRTKMDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVLVKHLQVMEQRQQQIMSFLAKAVQNPTFLSQFIQKQTDSNMHVTEANKKRRLREDSTAATESNSHSHSLEASDGQIVKYQPLRNDSMMWNMMKTDDKYPFLDGFSSPNQVSGVTLQEVLPITSGQSQAYASVPSGQPLSYLPSTSTSLPDTIMPETSQIPQLTRESINDFPTENFMDTEKNVPEAFISPSPFLDGGSVPIQLEGIPEDPEIDELMSNFEFLEEYMPESPVFGDATTLENNNNNNNNNNNNNNNNNNNNTNGRHMDKLIEELGLLTSETEH

SEQ ID NO: 50698 - protein, 393 aa, Arabidopsis thaliana; identical to SEQ ID NO: 9629
  misc_feature: Useful for making plants with modulated biomass
  misc_feature: Useful for making plants with modulated low light sensitivity

SEQ ID NO: 50699 - protein, 417 aa, Panicum virgatum; identical to SEQ ID NO: 20475
  misc_feature: Useful for making plants with altered carbohydrate content

SEQ ID NO: 50700 - protein, 475 aa, Panicum virgatum
  misc_feature: Useful for making plants with altered carbohydrate content
  misc_feature (259)..(259): Xaa is any aa, unknown, or other
MAPAVSSPTPHVAVVAFPFGSHAPALLAFARALAAAAAPAGATLSFLSTAGSIAQLRGAASAEIPGNLRFVEVPDGAGLPAAKGPVPVPVPRQMELFMAAAEAGGLKAGLEAARAMAGGARVSCVVGDAFVWPAAEAAAAAGSPWVPVWMGAPCALLAHLRTDALRAEVGDQAASRADELLASHPGLGSYCVGDLPDGVVSGDFNHVISRLVHRMGQLLPRAAAAAVALNTFPGLDPPDFTAVLAETLPNCLPLGLGLXHLLLPKDITDAAAPTAGDPHGCLAWVDAHPARSVVYVGFGRVASPRSDELRELAAGLESSGAPFLWSLREDSWPLLPEGFLARAAAAGAGLVVPWAPQVAVLRHASVGTFVTHAGWGSVLEALSSGVPMACRPFFGDHRMIARSVASVWGVGVAFEGAAMTRAGVAAAVGELLRGEEGARMRARAQELQAAAAAAFAPGGACRRNFDEFVEIVCRV

SEQ ID NO: 50701 - protein, 475 aa, Panicum virgatum; identical to SEQ ID NO: 3780
  misc_feature: Useful for making plants with modulated flowering time

SEQ ID NO: 50702 - protein, 158 aa, Arabidopsis thaliana
  misc_feature: Useful for making plants with altered lignin content
MAVRCLAVFLVALMVSQAVTATRPAPTKNVGAGLDDQKNFVAFAGVGGAAGIGGAGGVGAGLGGVAGGVGGVAGVLPVGGVGGGIGGLGGGVGGLGGLGGLGGGSGLGHGVGGIGGDPGIGSGIGGLGGAGGLGGIGGVGGLGGIGGGSDCGGVIPHH

SEQ ID NO: 50703 - protein, 378 aa, Arabidopsis thaliana
  misc_feature: Useful for making plants with altered terpenoid content
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLVEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 50704 - protein, 338 aa, Zea mays; identical to SEQ ID NO: 9402
  misc_feature: Useful for making plants with modulated nitrogen use efficiency

SEQ ID NO: 50705 - protein, 151 aa, Arabidopsis thaliana
  misc_feature: Useful for making plants with modulated biomass
MVGFKNRYMLMEVFLDPDKDLLGEGTPIILTQFNLSKAIKDSILVNFGECGLGSSLGSFQVKYVNPITKLCIVRSSREEHRQVWLAITLVKSIGNCPVILNLLDISGCIRACRDTALKCDKEKFEQCSKSLSEEEIRQMNTSLEKIKLLEN

SEQ ID NO: 50706 - protein, 487 aa, Panicum virgatum
  misc_feature: Useful for making plants with altered carbohydrate content
MTSGLRAHAGTIHKAATQHSGPLPAPAPDDRQPPARPAMESAACPARAAASVDLRWLLSVAAGGLFALLLLLAASPFQLPSSSRLFLSPASSSTQQRPPPPLYVESTLSRAAPPAASLPPRFAYLISGSAGDAGMMRRCLLALYHPRNRYILHLDAEAPDADRAGLAAFVAAHPVLSAAGNVRVIEKANLVTYRGPTMVTTTLHAAAAFLWGEGHGRGADWDWFINLSASDYPLVTQDDLMHVFSKLPRDLNFIDHTSNISWKAFARAMPVIIDPALYMKTKGDLFWVPEKRSLPTAFKLFTGSAWMVLSRAFVEYLIWGWDNLPRTVLMYYANFISSPEGYFHTVACNAAAFRNTTVNSDLHFISWDNPPMQHPHHLTLADWDRMLASGAPFARKFPRDDPVLDRIDADVLGRRPGAAGTVAPGGWCAAGGGEGDGSGAGGDPCAAVGDAAALRPGPGAERLQRLVTSLLSSENFRPRQCVVEEEN

SEQ ID NO: 50707 - protein, 301 aa, Glycine max
  misc_feature: Useful for making plants with modulated nitrogen use efficiency
MKDFPSCFGENAVQVADSSSSSSSKTAQNLVICVYQCRIWGKCCFITITWTKSLMGQGLSVGIDDYSSNQCLCKVDIKPWVFSKRRGCKSLEAYSCKIDVYWDLSNARFGVGPEPLEGFYVGVVVDRQMVLLLGDLRKEAFKKSSAIPLPSNAVFVAKKEHVFGKKMFGNKAVFCDNGQIHDLVIECDTSGVSDPCLIIRIDSKTVMQVKRLKWKFRGNHTILVDGLAVEVFWDVYNWLFGGTSLGNAVFMFRTCISAEKFWAGEPLSDANVVQWSFSQRFSETKSQGVGFSHILYAWKND

SEQ ID NO: 50708 - protein, 502 aa, Panicum virgatum; identical to SEQ ID NO: 4656
  misc_feature: Useful for making plants with altered carbohydrate content

SEQ ID NO: 50709 - protein, 591 aa, Arabidopsis thaliana
  misc_feature: Useful for making plants with modulated light quality sensitivity
METVEAGHDDVIGWFEHVSENACKVQSETLRRILELNSGVEYLRKWLGTVDVEKMDDYTLETLFTSLVPIVSHADLDPYIQRIADGETSPLLTQEPITVLSLSSGTTEGRQKYVPFTRHSAQTTLQIFRLSAAYRSRFYPIREGGRILEFIYAGKEFKTLGGLTVGTATTHYYASEEFKTKQETTKSFTCSPQEVISGGDFGQCTYCHLLLGLHYSSQVEFVASAFSYTIVQAFSFFEEIWREICADIKEGNLSSRITLPKMRKAVLALIRPNPSLASHIEEICLELETNLGWFGLISKLWPNAKFISSIMTGSMLPYLNKLRHYAGGLPLVSADYGSTESWIGVNVDPHLPPEDVSFAVIPTFSYFEFIPLYRRQNQSDICIDGDFVEDKPVPLSQVKLGQEYELVLTTFTGLYRYRLGDVVEVTSFHKGTPKLSFIYRRKLILTINIDKNTEKDLQRVVDKASQLLSRSTRAEVVDFTSHADVIARPGHYVIYWEIRGEADDKALEECCREMDTAFVDYGYVVSRRMNSIGPLELRVVERGTFGKVAERCVGKCGGLNQFKTPRCTTNSVMLDILNDSTIKRFRSSAYD

SEQ ID NO: 50710 - protein, 320 aa, Panicum virgatum; identical to SEQ ID NO: 28838
  misc_feature: Useful for making plants with altered carbohydrate content

SEQ ID NO: 50711 - protein, 377 aa, Arabidopsis thaliana; identical to SEQ ID NO: 9534
  misc_feature: Useful for making plants with modulated biomass
  misc_feature: Useful for making plants with modulated flowering time

SEQ ID NO: 50712 - protein, 377 aa, Zea mays; identical to SEQ ID NO: 9451
  misc_feature: Useful for making plants with modulated biomass

SEQ ID NO: 50713 - protein, 166 aa, Panicum virgatum; identical to SEQ ID NO: 1200
  misc_feature: Useful for making plants with altered carbohydrate content

SEQ ID NO: 50714 - protein, 168 aa, Arabidopsis thaliana
  misc_feature: Useful for making plants with altered cell wall content and/or composition
MELLSRALFFFLLLSVLSSFSSSSFISDGVFESQSLVLGRNLLQTKKTCPVNFEFMNYTIITSKCKGPKYPPKECCGAFKDFACPYTDQLNDLSSDCATTMFSYINLYGKYPPGLFANQCKEGKEGLECPAGSQLPPETSAEVNAATTSSSRLWLTVSAALLVFVKLF

SEQ ID NO: 50715 - protein, 319 aa, Arabidopsis thaliana
  misc_feature: Useful for making plants with altered lignin content
MSSFFPLPTSSSNESTRKKPYQTSSFRGMGCYAAAAAAAQEVSVPSVIRYSADLDARIRKDKKKKKHKHKKKKKKNKGSYEDGSIRILSEEARDVIDVWCRPGLGFSTDAVIGRSVDPPRGRNIPSSRRKIDVDNNNYNHTLGSSVLPIRFLNQETHSHDIFNSDSTFVTSSRAEPTMLSSRCRGHLPRSYPDDLTEMRMLQNGFVMGRITDSRDNYHELRLDVDSMSYEQLLELGDRIGYVNTGLKESEIHRCLGKIKPSVSHTLVDRKCSICQDEYEREDEVGELNCGHSFHVHCVKQWLSRKNACPVCKKAAYGKP

SEQ ID NO: 50716 - protein, 354 aa, Glycine max
  misc_feature: Useful for making plants with altered alkaloid content
MPVVTEHMKWRRPRNQFRHPISETDDPNPQIPSIIQSSHSKSTFSSLFSSFSTSNETRDQNRNNNNKSNRKFSAATFRGFGCTAGASQKVSVPVPAVIRSSADREGKSSRKKKHRRNSNSGNSTSDDDDDDVWCGPGIGFSTDAAAASVECVVARKNVSARGKLDVVEDRVTHRERSSYFGRRTVKPESFSFLEDEPDIFAARPGLEPFGTARFYRHVPHPSPDGLAEIMILQGRIMMGGRFDSHDQFRDWRLDVDNMSYEQLLELGERIGYVNTGLKEDEMGLNIRKVKPSSSNDASKHQLDKKCSVCQEEYESDDELGRLKCDHSYHFQCIKQWLVHKNFCPVCKQEVVVRH

SEQ ID NO: 50717 - protein, 543 aa, Lolium perenne
  misc_feature: Useful for making plants with altered lignin content
MVGFAKIAMEWIQDPLSWLFIASVVFVVLQRRRRGNVAPFPPGPKPLPIVGNMSMMDQLTHRGLAALAKEYGGLLHIRLGKLHTFAVSTPEYAREVLQVQDGAFSNRPATIAIAYLTYDRADMAFAHYGPFWRQMRKLCVMKLFSRRRPETWLAVRDESAALVRAVARRTGESVDLGELIFKLTKNVIFRAAFGAGAVAADAEEGDGAGKQDEFIAILQEFSKLFGAFNIGDFIPWLSWADPQGINVRLRAARNALDEFIDKIIDEHMERGKNPDDADADMVDDMLAFLPEAKPKKGAAGDGVDDLQNTLRLTRDNIKAIIMDVMFGGTETVASAIEWAMAEMMHSPDDLRRLQQELVDVVGLDRNVDESDLDKLPFLKCVIKETLRLHPPIPLLLHETAEDCVVGGYSVPRGSRVMINVYAIGRDRRAWKDADVFRPSRFVQGEGEAAGLDFKGGCFEFLPFGSGRRSCPGMALGLYALELAVAQLAHGFSWELPDGMKPSELDMSDVFGLTAPRATRLFAVPTPRLACTQLLGADDAGRQA

SEQ ID NO: 50718 - protein, 520 aa, Arabidopsis thaliana
  misc_feature: Useful for making plants with altered cell wall content and/or composition
  misc_feature: Useful for making plants with altered lignin content
MESSISQTLSKLSDPTTSLVIVVSLFIFISFITRRRRPPYPPGPRGWPIIGNMLMMDQLTHRGLANLAKKYGGLCHLRMGFLHMYAVSSPEVARQVLQVQDSVFSNRPATIAISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWTDPDTFRPSRFLEPGVPDFKGSNFEFIPFGSGRRSCPGMQLGLYALDLAVAHILHCFTWKLPDGMKPSELDMNDVFGLTAPKATRLFAVPTTRLICAL

SEQ ID NO: 50719 - protein, 439 aa, Arabidopsis thaliana
  misc_feature: Useful for making plants with modulated nitrogen use efficiency
MALNKLLSLTFQLLLFLLSVSSESPWIAEDTSQIQTKLLEFAKSPEVFDWMVKIRRKIHENPELGYEELETSKLIRSELELIGIKYRYPVAITGVIGYIGTGEPPFVALRADMDALPIQEGVEWEHKSKIAGKMHACGHDGHVTMLLGAAKILHEHRHHLQGTVVLIFQPAEEGLSGAKKMREEGALKNVEAIFGIHLSARIPFGKAASRAGSFLAGAGVFEAVITGKGGHAAIPQHTIDPVVAASSIVLSLQQLVSRETDPLDSKVVTVSKVNGGNAFNVIPDSITIGGTLRAFTGFTQLQQRVKEVITKQAAVHRCNASVNLTPNGREPMPPTVNNKDLYKQFKKVVRDLLGQEAFVEAAPVMGSEDFSYFAETIPGHFSLLGMQDETNGYASSHSPLYRINEDVLPYGAAIHASMAVQYLKEKASKGSVSGFHEEL

SEQ ID NO: 50720 - protein, 182 aa, Panicum virgatum
  misc_feature: Useful for making plants with altered carbohydrate content
MAVPVHLAASSLVLLLLVLLLPPLLASACDRCVHRSRAAYYASSLTLAGGSCGYGAEAASMGAGFLAAAGPALYRAGVGCGACFQVRCKDRKLCAAAGARVVVTDRARTNRADLVLSGPAFAAMARPGMAARLAKLRTVDVEYKRWVKSKSTCVFSFTNRAMRLILSSSARRTKETAAGRLL

SEQ ID NO: 50721 - protein, 215 aa, Arabidopsis thaliana
  misc_feature: Useful for making plants with altered cell wall content and/or composition
MATSFFAGHIAAAIPSIYKDGAGCGACFQVRCKNPKLCNSKGTIVMVTDLNTSNQTDLVLSSRAFRAMAKPVVGVDKYLLKQGIVDVEYQRVPCNYGKRNLNVRVEEASKKPNYLAIKLLYQGGQTEVVGIDIAPVGSSQWSYMSRSHGAVWATDKVPTGALQFKFTVTGGYDGKTVWSKRVLPANWNSGRIYDAGVQITDIAQEGCDTCGHIWN

SEQ ID NO: 50722 - protein, 577 aa, Arabidopsis thaliana
  misc_feature: Useful for making plants with modulated flowering time
MAEAEDQQNFVAHNGDQVPDQGSDELHNGLPYQVHDETLVHQPYEVEDPILEPQQYEVPDPTLEPQQYEVPDQTLEPQQYEVDDQLEYHQYQLQDQANEDVQDHSQDDLQYQPQNQEQFQLQDEAHDQAQYQAQGDVQDHNGDEVQDKVEDEEGIPEHLESLQKSEPEEDATVGGEEKRWPGWPGETVFRMLVPAQKVGSIIGRKGDVIKKIVEETRARIKILDGPPGTTERAVMVSGKEEPESSLPPSMDGLLRVHMRIVDGLDGEASQAPPPSKVSTRLLVPASQAGSLIGKQGGTVKAIQEASACIVRVLGSEDLPVFALQDDRVVEVVGEPTSVHRALELIASHLRKFLVDRSIIPFFENQMQKPTRQMDHMPPPHQSWGPPQGHAPSVGGGGYGHNPPPYMQPPPRHDSYYPPPEMRQPPMEKQPHQGISAYGREPPMNVHVSSAPPMVAQQVTQQMQIPLSYADAVIGTSGSNISYTRRLSGATVTIQETRGVPGEMTVEVSGTGSQVQTAVQLIQNFMAEAGAPAPAQPQTVAPEQQGYNPYATHGSVYAAAPTNPPGGYATDYSSGYGY

SEQ ID NO: 50723 - protein, 324 aa, Arabidopsis thaliana; identical to SEQ ID NO: 9367
  misc_feature: Useful for making plants with modulated nitrogen use efficiency
  misc_feature (248)..(248): Xaa is any aa, unknown, or other

SEQ ID NO: 50724 - protein, 283 aa, Panicum virgatum
  misc_feature: Useful for making plants with altered carbohydrate content
MRSLAVAVAAMACLAAVARAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTQGQGQREQQFRLWFDPTTAYHTYSIVWNPQHIIFAVDGTPIRDFKNHEAHGVAFPKSQPMRLYASLWNADDWATQGGRVKADWSHAPFVASFRGFRADACVWSGGRQQCPVGTMEAAARGWWSQQLSDTSYRRMRWVQRKFMIYNYCTDAKRFPQGVPAECHLR

SEQ ID NO: 50725 - protein, 120 aa, Arabidopsis thaliana
  misc_feature: Useful for making plants with altered cell wall content and/or composition
MSPFKIFFFTTLLVAAFSVSAADFNTDVNVAWGNGRGKILNNGQLLTLSLDKSSGSGFQSKTEYLFGKIDMQIKLVPGNSAGTVTTFYLKSEGSTWDEIDFEFLGNMSGDPYTLHTNVYT

SEQ ID NO: 50726 - protein, 404 aa, Arabidopsis thaliana; identical to SEQ ID NO: 9292
  misc_feature: Useful for making plants with modulated biomass

SEQ ID NO: 50727 - protein, 3678 aa, Arabidopsis thaliana; identical to SEQ ID NO: 9315
  misc_feature: Useful for making plants with altered cell wall content and/or composition

SEQ ID NO: 50728 - protein, 1084 aa, Arabidopsis thaliana
  misc_feature: Useful for making plants with modulated biomass
MNTGGRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRHEGDPDFEDGDDADFPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCL

SEQ ID NO: 50729 - protein, 393 aa, Arabidopsis thaliana; identical to SEQ ID NO: 9324
  misc_feature: Useful for making plants with altered tocopherol content

SEQ ID NO: 50730 - protein, 462 aa, Panicum virgatum; identical to SEQ ID NO: 4564
  misc_feature: Useful for making plants with altered carbohydrate content

SEQ ID NO: 50731 - protein, 305 aa, Panicum virgatum; identical to SEQ ID NO: 5662
  misc_feature: Useful for making plants with altered carbohydrate content

SEQ ID NO: 50732 - protein, 324 aa, Arabidopsis thaliana; identical to SEQ ID NO: 9289
  misc_feature: Useful for biocontainment applications
  misc_feature: Useful for making plants with altered cell wall content and/or composition
  misc_feature: Useful for making plants with altered lignin content
  misc_feature: Useful for making plants with modulated biomass

SEQ ID NO: 50733 - protein, 45 aa, Arabidopsis thaliana
  misc_feature: Useful for making plants with altered cell wall content and/or composition
LRWANYLRPDIKRGEFSPEEDDTIIKLHALKGNKWAAIATSLAGR

SEQ ID NO: 50734 - protein, 441 aa, Arabidopsis thaliana; identical to SEQ ID NO: 9463
  misc_feature: Useful for making plants with modulated light quality sensitivity
  misc_feature: Useful for making plants with modulated low light sensitivity

SEQ ID NO: 50735 - protein, 458 aa, Glycine max
  misc_feature: Useful for making plants with modulated oxidative stress sensitivity
MVRENAVMGGASEERGVRVTRAMARAVLGGVSASSRPSFKKQHKNNKGFGRVALADVTNISKKGCATSKSQARGGYKKTNTKGASNVSIQVLSTQEDVRAKLAKDLPSISMVQSHDANVAERQEGTEVVQPSMSVMAGPLLSMQDSMKSDEILRSPNKDVDMMITEKLKLSDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKVSYVELEFLANYLAELTLVEYSFLQFLPSLIAASAVLLARWTLNQSEHPWNSTMEHYTNYKVSELKTTVLALADLQHDMKGCSLNSIREKYKQQKFRSVANLSPKPVQSLFKAQV

SEQ ID NO: 50736 - protein, 324 aa, Arabidopsis thaliana
  misc_feature: Useful for making plants with altered cell wall content and/or composition
MLTDEREVVCVTGASGCIGSWLVHQLLLRGYSVHATVKNLQDEKETKHLEGLEGAATRLHLFEMDLLQYDTVSAAINGCSGVFHLASPCIVDEVQDPQKQLLDPAVKGTINVLTAAKEASVKRVVVTSSISAITPSPNWPADKIKNEECWAAEDYCRQNGLWYPLSKTLAEKAAWEFAEEKGLDVVVVNPGTVMGPVIPPSLNASMHMLLRLLQGCTETYENFFMGSVHFKDVALAHILVYEDPYSKGRHLCVEAISHYGDFVAKVAELYPNYNVPKLPRETQPGLLRDKNASKKLIDLGLKFISMEEIIKEGVESLKSKGFIS

SEQ ID NO: 50737 - protein, 353 aa, Arabidopsis thaliana
  misc_feature: Useful for making plants with modulated drought sensitivity
MAYEKELDAAKKAASLAARLCQKVQKALLQSDVQSKSDKSPVTVADYGSQAVVSLVLEKELSSEPFSLVAEEDSGDLRKDGSQDTLERITKLVNDTLATEESFNGSTLSTDDLLRAIDCGTSEGGPNGRHWVLDPIDGTKGFLRGDQYAVALGLLEEGKVVLGVLACPNLPLASIAGNNKNKSSSDEIGCLFFATIGSGTYMQLLDSKSSPVKVQVSSVENPEEASFFESFEGAHSLHDLSSSIANKLGVKAPPVRIDSQAKYGALSRGDGAIYLRFPHKGYREKIWDHVAGAIVVTEAGGIVTDAAGKPLDFSKGKYLDLDTGIIVANEKLMPLLLKAVRDSIAEQEKASAL

SEQ ID NO: 50738 - protein, 435 aa, Arabidopsis thaliana
  misc_feature: Useful for making plants with modulated heat sensitivity
MASSVLSECGFRPLPRFYPKHTTSFASNPKPTFKFNPPLKPPSSLLNSRYGFYSKTRNWALNVATPLTTLQSPSEEDTERFDPGAPPPFNLADIRAAIPKHCWVKNPWMSMSYVVRDVAIVFGLAAVAAYFNNWLLWPLYWFAQGTMFWALFVLGHDCGHGSFSNDPRLNSVAGHLLHSSILVPYHGWRISHRTHHQNHGHVENDESWHPLPESIYKNLEKTTQMFRFTLPFPMLAYPFYLWNRSPGKQGSHYHPDSDLFLPKEKKDVLTSTACWTAMAALLVCLNFVMGPIQMLKLYGIPYWIFVMWLDFVTYLHHHGHEDKLPWYRGKEWSYLRGGLTTLDRDYGWINNIHHDIGTHVIHHLFPQIPHYHLVEATEAAKPVLGKYYREPKNSGPLPLHLLGSLIKSMKQDHFVSDTGDVVYYEADPKLNGQRT

SEQ ID NO: 50739 - protein, 345 aa, Arabidopsis thaliana
  misc_feature: Useful for making plants with modulated biomass
MGRFKNNKKSRVIGKPIAKKNQEDVSHVTGDKIPKSFVFSRMKLAGPVKQLQMDLRKLMLPYTALSLKEKKRNTLRDFLNVSGPMGVTHFLMLSKTASSLSLRVARTPQGPTLTFKIHQYSLASDIAQSQLRPRCPQDLFKSPPLIVLSGFGSQELHLKLATIMFQNIFPAIDINTVKLSTCQRLVLLNYNKDTKLIDFRHYSIRLQPVGVSRRIRKFVQNHQVPDLRNLQDVSDFVTKAGYGSESEGDEEAATVTLSSDLGRVNKGATKSAVKLQEIGPRMTMQLVKVEEGLCTGGIIFSEYDVDGKKEKLKKKQDEEEEEDSEEEGEEGSEEDGEDMDEDFED

SEQ ID NO: 50740 - protein, 441 aa, Panicum virgatum; identical to SEQ ID NO: 27640
  misc_feature: Useful for making plants with altered carbohydrate content

SEQ ID NO: 50741 - protein, 118 aa, Arabidopsis thaliana
  misc_feature: Useful for biocontainment applications
  misc_feature: Useful for making plants with modulated nitrogen use efficiency
MARGKIQIKRIENQTNRQVTYSKRRNGLFKKAHELTVLCDARVSIIMFSSSNKLHGFVVSDFYDKYPKFLELVLPRIKEGKITYVEDVADGLEKAPEALVGLFHGKNVGKQVVVIARE

SEQ ID NO: 50742 - protein, 272 aa, Arabidopsis thaliana
  misc_feature: Useful for making plants with modulated biomass
MHRRAAIQESDDEEDETYNDVVPESPSSCEDSKISKPTPKKSRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 50743 - protein, 1145 aa, Arabidopsis thaliana
  misc_feature: Useful for making plants with altered cell wall content and/or composition
MASNKHFDKSRSNLSNNSDIQEPGRPPAGHSVKFAQRTSSGRYINYSRDDLDSELGGQDFMSYTVHIPPTPDNQPMDPSISQKVEEQYVANSMFTGGFKSNTRAHLMHKVIETEPNHPQMAGSKGSSCAIPGCDAKVMSDERGQDLLPCECDFKICRDCFIDAVKTGGGICPGCKEPYKNTHLTDQVDENGQQRPMLPGGGGSKMERRLSMVKSTNKSALMRSQTGDFDHNRWLFETTGTYGYGNAFWTKDGDFGSGKDGDGDGDGMGMEAQDLMSRPWRPLTRKLKIPAGVISPYRLLIFIRIVVLALFLTWRVKHQNPDAVWLWGMSVVCELWFALSWLLDQLPKLCPINRATDLQVLKEKFETPTASNPTGKSDLPGFDVFVSTADPEKEPPLVTANTILSILAAEYPVEKLSCYVSDDGGALLTFEAMAEAASFANIWVPFCRKHAIEPRNPDSYFSLKRDPYKNKVKSDFVKDRRRVKREFDEFKVRVNSLPDSIRRRSDAYHAREEIKAMKMQRQNRDDEPMEPVKIPKATWMADGTHWPGTWLTSASDHAKGDHAGIIQVMLKPPSDEPLHGVSEGFLDLTDVDIRLPLLVYVSREKRPGYDHNKKAGAMNALVRASAIMSNGPFILNLDCDHYIYNSEALREGMCFMMDRGGDRLCYVQFPQRFEGIDPSDRYANHNTVFFDVNMRALDGLMGPVYVGTGCLFRRIALYGFNPPRSKDFSPSCWSCCFPRSKKKNIPEENRALRMSDYDDEEMNLSLVPKKFGNSTFLIDSIPVAEFQGRPLADHPAVKNGRPPGALTIPRELLDASTVAEAIAVISCWYEDKTEWGSRIGWIYGSVTEDVVTGYRMHNRGWKSVYCVTKRDAFRGTAPINLTDRLHQVLRWATGSVEIFFSRNNALLASSKMKILQRIAYLNVGIYPFTSIFLIVYCFLPALSLFSGQFIVQTLNVTFLVYLLIISITLCLLALLEIKWSGISLEEWWRNEQFWLIGGTSAHLAAVLQGLLKVVAGVEISFTLTSKSGGDDIDDEFADLYMVKWTSLMIPPITIIMVNLIAIAVGFSRTIYSVVPQWSKLIGGVFFSFWVLAHLYPFAKGLMGRRGRTPTIVYVWSGLVAITISLLWVAINPPAGNTEIGGNFSFP

SEQ ID NO: 50744 - protein, 1088 aa, Arabidopsis thaliana
  misc_feature: Useful for making plants with altered cell wall content and/or composition
  misc_feature: Useful for making plants with modulated biomass
MNTGGRLIAGSHNRNEFVLINADDTARIRSAEELSGQTCKICRDEIELTDNGEPFIACNECAFPTCRPCYEYERREGNQACPQCGTRYKRIKGSPRVEGDEEDDDIDDLEHEFYGMDPEHVTEAALYYMRLNTGRGTDEVSHLYSASPGSEVPLLTYCDEDSDMYSDRHALIVPPSTGLGNRVHHVPFTDSFASIHTRPMVPQKDLTVYGYGSVAWKDRMEVWKKQQIEKLQVVKNERVNDGDGDGFIVDELDDPGLPMMDEGRQPLSRKLPIRSSRINPYRMLIFCRLAILGLFFHYRILHPVNDAFGLWLTSVICEIWFAVSWILDQFPKWYPIERETYLDRLSLRYEKEGKPSELAPVDVFVSTVDPLKEPPLITANTVLSILAVDYPVEKVACYVSDDGAAMLTFEALSYTAEFARKWVPFCKKFSIEPRAPEWYFSQKMDYLKHKVDPAFVMERRAMKRDYEEFKVKINALVSVSQKVPEDGWTMQDGTPWPGNNVRDHPGMIQVFLGHSGVCDMDGNELPRLVYVSREKRPGFDHHKKAGAMNSLIRVSAVLSNAPYLLNVDCDHYINNSKAIREAMCFMMDPQSGKKICYVQFPQRFDGIDRHDRYSNRNVVFFDINMKGLDGIQGPIYVGTGCVFRRQALYGFDAPKKKQPPGRTCNCWPKWCCLCCGMRKKKTGKVKDNQRKKPKETSKQIHALEHIEEGLQVTNAENNSETAQLKLEKKFGQSPVLVASTLLLNGGVPSNVNPASLLRESIQVISCGYEEKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLLVYCSLPAICLLTGKFIVPEISNYAGILFLLMFMSIAVTGILEMQWGKIGIDDWWRNEQFWVIGGVSSHLFALFQGLLKVLAGVSTNFTVTSKAADDGEFSELYIFKWTSLLIPPTTLLIINIVGVIVGVSDAINNGYDSWGPLFGRLFFALWVIVHLYPFLKGLLGKQDRVPTIILVWSILLASILTLLWVRVNPFVSKDGPVLEICGLDCLK

SEQ ID NO: 50745 - protein, 341 aa, Panicum virgatum; identical to SEQ ID NO: 17165
  misc_feature: Useful for making plants with altered carbohydrate content

SEQ ID NO: 50746 - protein, 307 aa, Arabidopsis thaliana; identical to SEQ ID NO: 9339
  misc_feature: Useful for making plants with altered lignin content
  misc_feature: Useful for making plants with altered terpenoid content

SEQ ID NO: 50747 - protein, 353 aa, Glycine max
  misc_feature: Useful for making plants with altered alkaloid content
MDYYYVSQHSQLESEADAYNVDVNDEHVKPSFNRRDSFSGKLFVGGISWETSQESFFNYFSKYGEVTDSVIMTNKLSGRPRGFGFVTFANSAVADEVLAQEHTIDHRVVEVKRTVPREDVDVTGVFKTKKIFVGGIAQFFTDDELREYFSPYGNVIECQIMLDHNTGRSRGFGFVTFDDEDSVEKVFSVGKIHEIGGKQVEIKRAEPKRSGVDYCNTSRKSYGGFGNEMDGHGGNSSRNRNHGKRGGQYTGSGMNGAYGHFDGSFGGSAATVYGGYCGYGYEFGYGGPMYCFGGYGLNSYGNPGGYGSGITSYGDVNAYGRAGSFNGSGGYDSSKVAEKGDGPTTGRYHPYWK

SEQ ID NO: 50748 - protein, 354 aa, Zea mays
  misc_feature: Useful for making plants with altered lignin content
MDSDYVASLLMGMGSSAPALDFAALDAGFLETLCGGGGGLFGVSGVAAGAGCGGVSPEGSSVSDPAWARARDDDNVRKRKEPPTGSAGGKEACPGKAAEAKGPDGKRCRVGGSDSPVKPKVEEVAASDASVELKAQKKGKGKTAKPAVEPPKDYVHVRARRGQATDSHSLAERVRREKISQRMKFLQDLVPGCNKVVGKALMLDEIINYVQSLQQQVEFLSMKLATVNPQLDFSNLSTLLHKDMYQPCGPSANSVFPLESDGAAFPFCDQADLFHSFGSGSAAMEDQCSLSLLDTALPHAANPQFAFQKQQRDFWEDGLQNALPTGSEQRQEEDGLLVPNFDGQLHADQTKVEF

SEQ ID NO: 50749 - protein, 251 aa, Glycine max; identical to SEQ ID NO: 9338
  misc_feature: Useful for making plants with altered protein content

SEQ ID NO: 50750 - protein, 224 aa, Arabidopsis thaliana
  misc_feature: Useful for making plants with modulated flowering time
IFNFESITLISHRRARERAKAVSSGNLRMSRVYVGNLDPRVTERELEDEFRSFGVIRSVWVARRPPGYAFLDFEDSRDARDAIREVDGKNGWRVEQSHNRGGGGGRGGGRGGGDGGRGRGGSDLKCYECGESGHFARECRSRGGSGGRRRSRSRSRSPPRYRKSPTYGGRRSYSPRARSPPPPRRRSPSPRGRNYSRSPPPYRARDEVPYANGNGLKDVRRSRS

SEQ ID NO: 50751 - protein, 415 aa, Arabidopsis thaliana
  misc_feature: Useful for making plants with altered cell wall content and/or composition
MVKLLLVGFVVAGIILGTQANEYLDFNVTEIDRIEELEFGFSKYSSNLNPLMVGLTLIRGADSGAVCLDGTLPGYHLHRGHGSGANSWLIQLEGGGWCNNIRTCVYRKTTRRGSSNYMEKQLQFTGILSDKAQENPDFFNWNRVKLRYCDGASFSGDGQNQAAQLQFRGERIWRAAIDDLKANGMRYANQALLSGCSAGGLAAILRCDEFRNLFPGSTKVKCLSDAGLFLDTADVSGGRTIRNLYNGVVELQSVKNNLPRICTNHLDPTSCFFPQNLISQMKTPLFIVNAAYDTWQIQSSIAPTSADPSGFWHDCRLNHGKCTPAQLRFLQGFREQMLRVVKGFSMSRQNGLFINSCFAHCQTERQDTWFADDSPVIRKKAVAIAVGDWYFDRAEVKLVDCPYPCDKSCHNLVFR

SEQ ID NO: 50752 - protein, 767 aa, Panicum virgatum; identical to SEQ ID NO: 4592
  misc_feature: Useful for making plants with altered carbohydrate content

SEQ ID NO: 50753 - protein, 429 aa, Arabidopsis thaliana
  misc_feature: Useful for making plants with modulated light quality sensitivity
  misc_feature: Useful for making plants with modulated low light sensitivity
MIGAVNSVEAVITSIQGLSGSPEDLSALHDLLRGAQDSLRAEPGVNFSTLDQLDASKHSLGYLYFLEVLTCGPVSKEKAAYEIPIIARFINSCDAGQIRLASYKFVSLCKILKDHVIALGDPLRGVGPLLNAVQKLQVSSKRLTALHPDVLQLCLQAKSYKSGFSILSDDIVEIDQPRDFFLYSYYGGMICIGLKRFQKALELLYNVVTAPMHQVNAIALEAYKKYILVSLIHNGQFTNTLPKCASTAAQRSFKNYTGPYIELGNCYNDGKIGELEALVVARNAEFEEDKNLGLVKQAVSSLYKRNILRLTQKYLTLSLQDIANMVQLGNAKEAEMHVLQMIQDGQIHALINQKDGMVRFLEDPEQYKSSEMIEIMDSVIQRTIGLSKNLLAMDESLSCDPLYLGKVGRERQRYDFGDDFDTVPQKFSM

SEQ ID NO: 50754 - protein, 441 aa, Oryza sativa subsp. japonica
  misc_feature: Useful for making plants with modulated biomass
MLRSLHSSSSSDTDNNSGGCKNNGGGGGEAAAAVEGGGDQRAVAAAAPSTRDLLLACADLLQRGDLPAARRAAEIVLAAAASPRGDAADRLAYHFARALALRVDAKAGHGHVVVGGGAARPASSGAYLAFNQIAPFLRFAHLTANQAILEAVDGARRVHILDLDAVHGVQWPPLLQAIAERADPALGPPEVRVTGAGADRDTLLRTGNRLRAFARSIHLPFHFTPLLLSCATTAPHHVAGTSTGAAAAASTAAAATGLEFHPDETLAVNCVMFLHNLAGHDELAAFLKWVKAMSPAVVTIAEREAGGGGGGGDHIDDLPRRVGVAMDHYSAVFEALEATVPPGSRERLAVEQEVLGREIEAAVGPSGGRWWRGIERWGGAARAAGFAARPLSAFAVSQARLLLRLHYPSEGYLVQEARGACFLGWQTRPLLSVSAWQPSSS

SEQ ID NO: 50755 - protein, 130 aa, Arabidopsis thaliana; identical to SEQ ID NO: 9225
  misc_feature: Useful for making plants with modulated nitrogen use efficiency

SEQ ID NO: 50756 - protein, 679 aa, Panicum virgatum; identical to SEQ ID NO: 25120
  misc_feature: Useful for making plants with altered carbohydrate content

SEQ ID NO: 50757 - protein, 462 aa, Arabidopsis thaliana
  misc_feature: Useful for making plants with modulated nitrogen use efficiency
MAVATHCFTSPCHDRIRFFSSDDGIGRLGITRKRINGTFLLKILPPIQSADLRTTGGRSSRPLSAFRSGFSKGIFDIVPLPSKNELKELTAPLLLKLVGVLACAFLIVPSADAVDALKTCACLLKGCRIELAKCIANPACAANVACLQTCNNRPDETECQIKCGDLFENSVVDEFNECAVSRKKCVPRKSDLGEFPAPDPSVLVQNFNISDFNGKWYITSGLNPTFDAFDCQLHEFHTEGDNKLVGNISWRIKTLDSGFFTRSAVQKFVQDPNQPGVLYNHDNEYLHYQDDWYILSSKIENKPEDYIFVYYRGRNDAWDGYGGAVVYTRSSVLPNSIIPELEKAAKSIGRDFSTFIRTDNTCGPEPALVERIEKTVEEGERIIVKEVEEIEEEVEKEVEKVGRTEMTLFQRLAEGFNELKQDEENFVRELSKEEMEFLDEIKMEASEVEKLFGKALPIRKVR

SEQ ID NO: 50758 - protein, 490 aa, Arabidopsis thaliana
  misc_feature: Useful for making plants with modulated light quality sensitivity
MYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWK

SEQ ID NO: 50759 - protein, 1091 aa, Arabidopsis thaliana; identical to SEQ ID NO: 9454
  misc_feature: Useful for making plants with modulated low light sensitivity

SEQ ID NO: 50760 - protein, 480 aa, Panicum virgatum; identical to SEQ ID NO: 30435
  misc_feature: Useful for making plants with altered carbohydrate content

SEQ ID NO: 50761 - protein, 480 aa, Arabidopsis thaliana
  misc_feature: Useful for making plants with altered cell wall content and/or composition
MVKICCIGAGYVGGPTMAVIALKCPDVEVAVVDISVPRINAWNSDTLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIKDLFNPDRVLIGGRETPEGFKAVQTLKNVYAHWVPEGQIITTNLWSAELSKLAANAFLAQRISSVNAMSALCEATGADVTQVSYAVGTDSRIGPKFLNSSVGFGGSCFQKDILNLVYICECNGLPEVAEYWKQVIKINDYQKSRFVNRVVSSMFNSVSNKKIAVLGFAFKKDTGDTRETPAIDVCKGLLEDKARLSIYDPQVTEDQIQRDLSMNKFDWDHPLHLQPMSPTTVKQVTVTWDAYEATKDAHGICIMTEWDEFKNLDFQKIFDNMQKPAFVFDGRNIMNLQKLREIGFIVYSIGKPLDDWLKDMPAVA

SEQ ID NO: 50762 - protein, 388 aa, Arabidopsis thaliana
  misc_feature: Useful for biocontainment applications
MGNISSSGGEGRRRRRRNHTAAPPPPPPPPSSSLPPPPLPTEIQANPIVFAAVTPYPNPNPNPVYQYPASYYHHPPPGAMPLPPYDHHLQHHPPHPYHNHSWAPVAMARYPYAGHMMAQPTPYVEHQKAVTIRNDVNLKKESLRLEPDPDNPGRFLVSFTFDATVSGRISVIFFAKESEDCKLTATKEDILPPITLDFEKGLGQKFKQSSGSGIDFSVFEDVELFKAAADTEIYPLAVKAEAAPSGGENEEEERSGSKNAQITQAVYEKDKGEIKIRVVKQILWVNGTRYELQEIYGIGNTVEGDDDSADDANDPGKECVICLSEPRDTTVLPCRHMCMCSGCAKVLRFQTNRCPICRQPVERLLEIKVHGNNGSGNNTGQGETVEQE

SEQ ID NO: 50763 - protein, 340 aa, Glycine max
  misc_feature: Useful for making plants with altered alkaloid content
  misc_feature: Useful for making plants with altered terpenoid content
MGNISSGGNPRRRHSGASRRSHPPPPPPVTPQPEIAANPFVYHGAAAPYPNPPLHYPQYHYPGYYPPVPPMPYHPHQHQHHHRHMDPAWIQGHFPSGPMMPNPAPFVEHQKAVTIKNDVNIRKETLKLEPDVENSGHFLVSFSFDATVSGSITIYFFAKEGEGCILTPMKENQLAPVSVHFEQGLGQKFRQAAGTGIDFSVFEESELLKVGEKDVYPLAVKADASPGNHDESDRSPTSSNTNSQITQTMFEKEKGEFRVKVVKQILWVNGMRYELQEIYGIRNSTENDQGKCVICLSEPRDTIVLPCRHMCMCSGCAKDSRFQTDRCSICRQPVERLLEI

SEQ ID NO: 50764 - protein, 337 aa, Arabidopsis thaliana
  misc_feature: Useful for making plants with modulated nitrogen use efficiency
MGNLISLIFCCGRRQRSNIPPAMETAPLELPPNRFVFAAAPPYLNPNPNYVDQYPGNCLPPPVTEPPMLPYNFNHLHHYPPNSYQLPHPLFHGGRYPILPPPTYVHQKAVTIRNDVNLKKKTLTLIPDPENPNRLLVSFTFDASMPGRITVVFFATEDAECNLRATKEDTLPPITFDFGEGLGQKFIQSSGTGIDLTAFKDSELFKEVDTDVFPLAVKAEATPAEEGKSGSTNVQITQVVYTKEKGEIKIEVVKQILWVNKRRYELLEIYGIENTVDGSDEGKECVVCLSEPRDTTVLPCRHMCMCSGCAKALRFQTNLCPVCRQPVEMLLEINKNG

SEQ ID NO: 50765 - protein, 655 aa, Arabidopsis thaliana
  misc_feature: Useful for making plants with altered cell wall content and/or composition
MANSPAAPAPTTTTGGDSRRRLSASIEAICKRRFRRNSKGGGRSDMVKPFNIINFSTQDKNSSCCCFTKFQIVKLLLFILLSATLFTIIYSPEAYHHSLSHSSSRRQDPRYFSDLDINWDDVTKTLENIEEGRTIGVLNFDSNEIQRWREVSKSKDNGDEEKVVVLNLDYADKNVTWDALYPEWIDEEQETEVPVCPNIPNIKVPTRRLDLIVVKLPCRKEGNWSRDVGRLHLQLAAATVAASAKGFFRGHVFFVSRCFPIPNLFRCKDLVSRRGDVWLYKPNLDTLRDKLQLPVGSCELSLPLGIQDRPSLGNPKREAYATILHSAHVYVCGAIAAAQSIRQSGSTRDLVILVDDNISGYHRSGLEAAGWQIRTIQRIRNPKAEKDAYNEWNYSKFRLWQLTDYDKIIFIDADLLILRNIDFLFSMPEISATGNNGTLFNSGVMVIEPCNCTFQLLMEHINEIESYNGGDQGYLNEVFTWWHRIPKHMNFLKHFWIGDEDDAKRKKTELFGAEPPVLYVLHYLGMKPWLCYRDYDCNFNSDIFVEFATDIAHRKWWMVHDAMPQELHQFCYLRSKQKAQLEYDRRQAEAANYADGHWKIRVKDPRFKICIDKLCNWKSMLRHWGESNWTDYESFVPTPPAITVDRRSSLPGHNL

SEQ ID NO: 50766 - protein, 560 aa, Arabidopsis thaliana
  misc_feature: Useful for making plants with altered cell wall content and/or composition
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 50767 - protein, 439 aa, Panicum virgatum; identical to SEQ ID NO: 2436
  misc_feature: Useful for making plants with altered carbohydrate content

SEQ ID NO: 50768 - protein, 429 aa, Arabidopsis thaliana
  misc_feature: Useful for making plants with altered cell wall content and/or composition
MPSIEDELFPSTPGKFKIDRSNRQLHRCFASTSTMFLWALFLIALTASYLSFQSFVDSGSRYLTASWGGIQWEKQVRTSAQIHRSGGISVLVTGATGFVGSHVSLALRKRGDGVVGLDNFNNYYDPSLKRARRSLLSSRGIFVVEGDLNDAKLLAKLFDVVAFTHVMHLAAQAGVRYALENPQSYVHSNIAGLVNLLEICKAANPQPAIVWASSSSVYGLNEKVPFSESDRTDQPASLYAATKKAGEEITHTYNHIYGLAITGLRFFTVYGPWGRPDMAYFSFTRNILQGKPITIYRGKNRVDLARDFTYIDDIVKGCLGSLDSSGKSTGSGGKKRGAAPYRIFNLGNTSPVTVPILVDILEKHLKVKAKRNFVEMPGNGDVPFTHANISSARNEFGYKPTTDLETGLKKFVRWYLSYYGYNTKAKLVH

SEQ ID NO: 50769 - protein, 518 aa, Arabidopsis thaliana
  misc_feature: Useful for biocontainment applications
  misc_feature: Useful for making plants with modulated nitrogen use efficiency
MASISTPFPISLHPKTVRSKPLKFRVLTRPIKASGSETPDLTVATRTGSKDLPIRNIPGNYGLPIVGPIKDRWDYFYDQGAEEFFKSRIRKYNSTVYRVNMPPGAFIAENPQVVALLDGKSFPVLFDVDKVEKKDLFTGTYMPSTELTGGYRILSYLDPSEPKHEKLKNLLFFLLKSSRNRIFPEFQATYSELFDSLEKELSLKGKADFGGSSDGTAFNFLARAFYGTNPADTKLKADAPGLITKWVLFNLHPLLSIGLPRVIEEPLIHTFSLPPALVKSDYQRLYEFFLESAGEILVEADKLGISREEATHNLLFATCFNTWGGMKILFPNMVKRIGRAGHQVHNRLAEEIRSVIKSNGGELTMGAIEKMELTKSVVYECLRFEPPVTAQYGRAKKDLVIESHDAAFKVKAGEMLYGYQPLATRDPKIFDRADEFVPERFVGEEGEKLLRHVLWSNGPETETPTVGNKQCAGKDFVVLVARLFVIEIFRRYDSFDIEVGTSPLGSSVNFSSLRKASF

SEQ ID NO: 50770 - protein, 549 aa, Panicum virgatum; identical to SEQ ID NO: 4116
  misc_feature: Useful for making plants with altered carbohydrate content

SEQ ID NO: 50771 - protein, 495 aa, Arabidopsis thaliana
  misc_feature: Useful for making plants with altered cell wall content and/or composition
MITAALHEPQIHKPTDTSVVSDDVLPHSPPTPRIFRSKLPDIDIPNHLPLHTYCFEKLSSVSDKPCLIVGSTGKSYTYGETHLICRRVASGLYKLGIRKGDVIMILLQNSAEFVFSFMGASMIGAVSTTANPFYTSQELYKQLKSSGAKLIITHSQYVDKLKNLGENLTLITTDEPTPENCLPFSTLITDDETNPFQETVDIGGDDAAALPFSSGTTGLPKGVVLTHKSLITSVAQQVDGDNPNLYLKSNDVILCVLPLFHIYSLNSVLLNSLRSGATVLLMHKFEIGALLDLIQRHRVTIAALVPPLVIALAKNPTVNSYDLSSVRFVLSGAAPLGKELQDSLRRRLPQAILGQGYGMTEAGPVLSMSLGFAKEPIPTKSGSCGTVVRNAELKVVHLETRLSLGYNQPGEICIRGQQIMKEYLNDPEATSATIDEEGWLHTGDIGYVDEDDEIFIVDRLKEVIKFKGFQASPFIFIVLFIFNKCLHLKKIYIMI

SEQ ID NO: 50772 - protein, 545 aa, Zea mays; identical to SEQ ID NO: 9391
  misc_feature: Useful for making plants with modulated heat sensitivity
  misc_feature (509)..(509): Xaa is any aa, unknown, or other

SEQ ID NO: 50773 - protein, 539 aa, Arabidopsis thaliana
  misc_feature: Useful for making plants with altered cell wall content and/or composition
MESSLFSPSSSSYSSLFTAKPTRLLSPKPKFTFSIRSSIEKPKPKLETNSSKSQSWVSPDWLTTLTRTLSSGKNDESGIPIANAKLDDVADLLGGALFLPLYKWMNEYGPIYRLAAGPRNFVIVSDPAIAKHVLRNYPKYAKGLVAEVSEFLFGSGFAIAEGPLWTARRRAVVPSLHRRYLSVIVERVFCKCAERLVEKLQPYAEDGSAVNMEAKFSQMTLDVIGLSLFNYNFDSLTTDSPVIEAVYTALKEAELRSTDLLPYWKIDALCKIVPRQVKAEKAVTLIRETVEDLIAKCKEIVEREGERINDEEYVNDADPSILRFLLASREEVSSVQLRDDLLSMLVAGHETTGSVLTWTLYLLSKNSSALRKAQEEVDRVLEGRNPAFEDIKELKYITRCINESMRLYPHPPVLIRRAQVPDILPGNYKVNTGQDIMISVYNIHRSSEVWEKAEEFLPERFDIDGAIPNETNTDFKFIPFSGGPRKCVGDQFALMEAIVALAVFLQRLNVELVPDQTISMTTGATIHTTNGLYMKVSQR

SEQ ID NO: 50774 - protein, 576 aa, Panicum virgatum; identical to SEQ ID NO: 6328
  misc_feature: Useful for making plants with altered carbohydrate content

SEQ ID NO: 50775 - protein, 439 aa, Panicum virgatum; identical to SEQ ID NO: 20117
  misc_feature: Useful for making plants with altered carbohydrate content

SEQ ID NO: 50776 - protein, 706 aa, Panicum virgatum
  misc_feature: Useful for making plants with altered carbohydrate content
MSAPAPSSPATPVNPPAPVPPTPAPVPPTPSPVPPTPAPVLPTPSPLPPTPSPVPPTPSPLPPSPTPTPSPPPPVVTPSPPPPVPVVPTPSPPPPATVPTASPPPPATVPTPSPPPPATVPTPSPPPPATAPTPSPPPPVRRPPPPPSDVPTSPPPPTGVPASPAPPPPSHLSLPPPPPPSSPGTPPTSSPSKSTVNGTAVGIGVAVGAVVLLGLAAGLIYFFVGRKRRRRPPPSQGYPAEFYDPRRPVTTPPHMSHAPSTTPSSSTPPLMHSWQSSRGPSEPLMPPLNPSPAMTGGTFAYDDLAAATDGFSDANLLGQGGFGHVYRGTLGGQEVAIKKLRAGSGQGDREFRAEVEIISRVHHKNLVSLVGYCLYGEQRLLVYEYVPNKTLEFHLHGSGRPTLDWPRRWKIAVGSAKGLAYLHEDCHPKIIHRDIKAANILLDYNYEPKVADFGLAKYQAAEVTAVSTRVMGTFGYLAPEYAATGKVSDRSDVFSFGVMLLELITGRKPIMTSSAYQPETLVSWARPLLTRAVEEENYDELIDPRLETNYDAYDMARLIACAAAAVRQTARSRPRMSQIVRYLEGELSVEDLNAGVRPGQSAMQRSGGDTTDQIGRLRRMAFGPGAGGSTTGTGAGTITEYASSEFSDPTSEYGLNPSSEYTASSGGDTGEVPPAAQGQGQQWPGRRAAGDTERMSRRTIGRRGQT

SEQ ID NO: 50777 - protein, 466 aa, Arabidopsis thaliana
  misc_feature: Useful for making plants with modulated nitrogen use efficiency
MAVALQFSRLCVRPDTFVRENHLSGSGSLRRRKALSVRCSSGDENAPSPSVVMDSDFDAKVFRKNLTRSDNYNRKGFGHKEETLKLMNREYTSDILETLKTNGYTYSWGDVTVKLAKAYGFCWGVERAVQIAYEARKQFPEERLWITNEIIHNPTVNKRLEDMDVKIIPVEDSKKQFDVVEKDDVVILPAFGAGVDEMYVLNDKKVQIVDTTCPWVTKVWNTVEKHKKGEYTSVIHGKYNHEETIATASFAGKYIIVKNMKEANYVCDYILGGQYDGSSSTKEEFMEKFKYAISKGFDPDNDLVKVGIANQTTMLKGETEEIGRLLETTMMRKYGVENVSGHFISFNTICDATQERQDAIYELVEEKIDLMLVVGGWNSSNTSHLQEISEARGIPSYWIDSEKRIGPGNKIAYKLHYGELVEKENFLPKGPITIGVTSGASTPDKVVEDALVKVFDIKREELLQLA

SEQ ID NO: 50778 - protein, 447 aa, Panicum virgatum; identical to SEQ ID NO: 6698
  misc_feature: Useful for making plants with altered carbohydrate content

SEQ ID NO: 50779 - protein, 475 aa, Arabidopsis thaliana
  misc_feature: Useful for making plants with altered cell wall content and/or composition
MEPEKNPTTVLSAITRPSWAFLLLVFTVLAILSLQISSNSFLPLWIPTSQYDDPVTCSGFFNHDPFPNRIVMSITDFGGVGDGKTSNTAAFRRAVRHLEGFAAEGGAQLNVPEGTWLSGSFNLTSNFTLFLERGALILGSKDLDEWPIIEPLPSYGRGRERPGGRHISLIHGDNLTNVVITGENGTIDGQGKMWWELWWNRTLVHTRGHLIELKNSHNILISNLTLLNSPFWTIHPVYCSNVVIRNMTILAPMNAPNTDGIDPDSSTNVCIEDCYIESGDDLVAVKSGWDQYGMAVARPSSNIVIRRISGTTRTCSGVGIGSEMSGGIFNITVEDIHVWDSAAGLRIKTDKGRGGYISNITFNNVLLEKVKVPIRFSSGSNDHSDDKWDPKALPRVKGIYISNVVSLNSRKAPMLLGVEGTSFQDVCLRNVTLLGLPKTEKWKCKDVSGYASDVFPLSCPQLLQKKGSIAQCSYR

SEQ ID NO: 50780 - protein, 387 aa, Panicum virgatum; identical to SEQ ID NO: 2182
  misc_feature: Useful for making plants with altered carbohydrate content

SEQ ID NO: 50781 - protein, 1110 aa, Arabidopsis thaliana; identical to SEQ ID NO: 9261
  misc_feature: Useful for making plants with altered lignin content

SEQ ID NO: 50782 - protein, 131 aa, Arabidopsis thaliana
  misc_feature: Useful for making plants with altered terpenoid content
  misc_feature: Useful for making plants with modulated flowering time
  misc_feature (9)..(9): Xaa is any aa, unknown, or other
MSMRRSKAXGKRSLRELSEEEEEEEETEDEDTFEEEEALEKKQKGKATSSSGVCQVESCTADISKAKQYHKRHKVCQFHAKAPHVRISGLHQRFCQQCSRFHALSEFDEAKRSCRRRLAGHNERRRKSTTD

SEQ ID NO: 50783 - protein, 97 aa, Arabidopsis thaliana; identical to SEQ ID NO: 9666
  misc_feature: Useful for making plants with modulated drought sensitivity

SEQ ID NO: 50784 - protein, 195 aa, Arabidopsis thaliana
  misc_feature: Useful for making plants with altered alkaloid content
  misc_feature: Useful for making plants with altered lignin content
  misc_feature: Useful for making plants with modulated nitrogen use efficiency
MARSPCCEKNGLKKGPWTSEEDQKLVDYIQKHGYGNWRTLPKNAGLQRCGKSCRLRWTNYLRPDIKRGRFSFEEEETIIQLHSFLGNKWSAIAARLPGRTDNEIKNFWNTHIRKKLLRMGIDPVTHSPRLDLLDISSILASSLYNSSSHHMNMSRLMMDTNRRHHQQHPLVNPEILKLATSLFSQNQNQEPCGGS

SEQ ID NO: 50785 - protein, 191 aa, Arabidopsis thaliana
  misc_feature: Useful for making plants with modulated biomass
  misc_feature: Useful for making plants with modulated flowering time
MEEDLILINYIANHGEGVWNSLAKSAGLKRTGKSCRLRWLNYLRPDVRRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESSSIMMPLSVDQSEQNYWSVDDLWPMNIYNGN

SEQ ID NO: 50786 - protein, 435 aa, Arabidopsis thaliana
  misc_feature: Useful for making plants with altered terpenoid content
MQTTNGSDSTLATSGATPPNQQTPPPPQQWQQQQQQQQQWMAAMQYPPAAAMMMMQQQQMLMYPHQYVPYNQGPYQQHHPQLHQYGSYQQHQHQQHKAIDRGSGDDVKTLWVGDLLHWMDETYLHSCFSHTGEVSSVKVIRNKLTSQSEGYGFVEFLSRAAAEEVLQNYSGSVMPNSDQPFRINWASFSTGEKRAVENGPDLSVFVGDLSPDVTDVLLHETFSDRYPSVKSAKVVIDSNTGRSKGYGFVRFGDENERSRALTEMNGAYCSNRQMRVGIATPKRAIANQQQHSSQAVILAGGHGSNGSMGYGSQSDGESTNATIFVGGIDPDVIDEDLRQPFSQFGEVVSVKIPVGKGCGFVQFADRKSAEDAIESLNGTVIGKNTVRLSWGRSPNKQWRGDSGQQWNGGYSRGHGYNNGGGYANHHDSNNYHGEN

SEQ ID NO: 50787 - protein, 725 aa, Arabidopsis thaliana
  misc_feature: Useful for making plants with altered cell wall content and/or composition
  misc_feature: Useful for making plants with altered lignin content
MEINGAHKSNGGGVDAMLCGGDIKTKNMVINAEDPLNWGAAAEQMKGSHLDEVKRMVAEFRKPVVNLGGETLTIGQVAAISTIGNSVKVELSETARAGVNASSDWVMESMNKGTDSYGVTTGFGATSHRRTKNGVALQKELIRFLNAGIFGSTKETSHTLPHSATRAAMLVRINTLLQGFSGIRFEILEAITSFLNNNITPSLPLRGTITASGDLVPLSYIAGLLTGRPNSKATGPNGEALTAEEAFKLAGISSGFFDLQPKEGLALVNGTAVGSGMASMVLFETNVLSVLAEILSAVFAEVMSGKPEFTDHLTHRLKHHPGQIEAAAIMEHILDGSSYMKLAQKLHEMDPLQKPKQDRYALRTSPQWLGPQIEVIRYATKSIEREINSVNDNPLIDVSRNKAIHGGNFQGTPIGVSMDNTRLAIAAIGKLMFAQFSELVNDFYNNGLPSNLTASRNPSLDYGFKGAEIAMASYCSELQYLANPVTSHVQSAEQHNQDVNSLGLISSRKTSEAVDILKLMSTTFLVAICQAVDLRHLEENLRQTVKNTVSQVAKKVLTTGVNGELHPSRFCEKDLLKVVDREQVYTYADDPCSATYPLIQKLRQVIVDHALINGESEKNAVTSIFHKIGAFEEELKAVLPKEVEAARAAYDNGTSAIPNRIKECRSYPLYRFVREELGTELLTGEKVTSPGEEFDKVFTAICEGKIIDPMMECLNEWNGAPIPIC

SEQ ID NO: 50788 - protein, 497 aa, Glycine max; identical to SEQ ID NO: 9637
  misc_feature: Useful for making plants with altered lignin content
  misc_feature (99)..(99): Xaa is any aa, unknown, or other

SEQ ID NO: 50789 - protein, 532 aa, Arabidopsis thaliana
  misc_feature: Useful for making plants with modulated biomass
  misc_feature: Useful for making plants with modulated flowering time
MEEVVVVVADPPPKITTVVEYEEELEDDDDDLSLSSDSDIAEALDWLDGKDDDELIGGGFSLHARRPNAHGGHGSRPNSSALQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLELIIQMRVLYQKCKLVHGDLSEYNILYFEGHLYIIDVSQSVDLDHPLALNFLREDCDHVSDFFKKHGVAVMTIRELFDFIVDPTISDENVDSYLEEVQRKVIERGEISVEDEIADSVFMKSYIPKSLDAVNNPEADVAKITSGQDTGDMLYQTITGLKDALPKVDEQQIEVNAEEEEEEEEEGSGEESEEESEEELGPEDKKAARKEHKKKVKEEKRESRKTKTPKSVKKRKKKVSKPHKTR

SEQ ID NO: 50790 - protein, 538 aa, Panicum virgatum; identical to SEQ ID NO: 3946
  misc_feature: Useful for making plants with altered carbohydrate content

SEQ ID NO: 50791 - protein, 501 aa, Arabidopsis thaliana
  misc_feature: Useful for making plants with altered cell wall content and/or composition
MAALLLLFLFLFASSALSQDSLIGVNIGTEVTNMPSPTQVVALLKSQNINRVRLYDADRSMLLAFAHTGVQVIISVPNDQLLGISQSNATAANWVTRNVAAYYPATNITTIAVGSEVLTSLTNAASVLVSALKYIQAALVTANLDRQIKVSTPHSSTIILDSFPPSQAFFNKTWDPVIVPLLKFLQSTGSPLLLNVYPYFDYVQSNGVIPLDYALFQPLQANKEAVDANTLLHYTNVFDAIVDAAYFAMSYLNFTNIPIVVTESGWPSKGGPSEHDATVENANTYNSNLIQHVINKTGTPKHPGTAVTTYIYELYNEDTRPGPVSEKNWGLFYTNGTPVYTLRLAGAGAILANDTTNQTFCIAKEKVDRKMLQAALDWACGPGKVDCSALMQGESCYEPDDVVAHSTYAFNAYYQKMGKASGSCDFKGVATVTTTDPSRGTCVFPGSAKSNQTLGNNTSALAPSANSTTSGCIPKYYHHPHASFGDLTLLSLLLIIALVFL

SEQ ID NO: 50792 - protein, 119 aa, Arabidopsis thaliana
  misc_feature: Useful for making plants with modulated drought sensitivity
  misc_feature: Useful for making plants with modulated water use efficiency
MSTFLIRILLPLLIIAMTLPRRSEAESEQWCIADEQTPDDELQAALDWACGKGGADCSKMQQENQPCFLPNTIRDHASFAFNSYYQTYKNKGGSCYFKGAAMITELDPSHGSCQYEYNP

SEQ ID NO: 50793 - protein, 985 aa, Arabidopsis thaliana
  misc_feature: Useful for making plants with modulated biomass
MMESRSPICNTCGEEIGVKSNGEFFVACHECSFPICKACLEYEFKEGRRICLRCGNPYDENVFDDVETKTSKTQSIVPTQTNNTSQDSGIHARHISTVSTIDSELNDEYGNPIWKNRVESWKDKKDKKSKKKKKDPKATKAEQHEAQIPTQQHMEDTPPNTESGATDVLSVVIPIPRTKITSYRIVIIMRLIILALFFNYRITHPVDSAYGLWLTSVICEIWFAVSWVLDQFPKWSPINRETYIDRLSARFEREGEQSQLAAVDFFVSTVDPLKEPPLITANTVLSILALDYPVDKVSCYVSDDGAAMLSFESLVETADFARKWVPFCKKYSIEPRAPEFYFSLKIDYLRDKVQPSFVKERRAMKRDYEEFKIRMNALVAKAQKTPEEGWTMQDGTSWPGNNTRDHPGMIQVFLGYSGARDIEGNELPRLVYVSREKRPGYQHHKKAGAENALVRVSAVLTNAPFILNLDCDHYVNNSKAVREAMCFLMDPVVGQDVCFVQFPQRFDGIDKSDRYANRNIVFFDVNMRGLDGIQGPVYVGTGTVFRRQALYGYSPPSKPRILPQSSSSSCCCLTKKKQPQDPSEIYKDAKREELDAAIFNLGDLDNYDEYDRSMLISQTSFEKTFGLSTVFIESTLMENGGVPDSVNPSTLIKEAIHVISCGYEEKTEWGKEIGWIYGSITEDILTGFKMHCRGWRSIYCMPLRPAFKGSAPINLSDRLHQVLRWALGSVEIFLSRHCPLWYGCSGGRLKLLQRLAYINTIVYPFTSLPLVAYCTLPAICLLTGKFIIPTLSNLASMLFLGLFISIILTSVLELRWSGVSIEDLWRNEQFWVIGGVSAHLFAVFQGFLKMLAGLDTNFTVTSKTADDLEFGELYIVKWTTLLIPPTSLLIINLVGVVAGFSDALNKGYEAWGPLFGKVFFAFWVILHLYPFLKGLMGRQNRTPTIVILWSILLASVFSLVWVRINPFVSKTDTTSLSLNCLLIDC

SEQ ID NO: 50794 - protein, 985 aa, Arabidopsis thaliana; identical to SEQ ID NO: 50793
  misc_feature: Useful for making plants with altered cell wall content and/or composition

SEQ ID NO: 50795 - protein, 299 aa, Oryza sativa
  misc_feature: Useful for making plants with modulated biomass
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERSRADPTMLVVTYTSDHNHPWPTHRNALAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 50796 - protein, 573 aa, Panicum virgatum; identical to SEQ ID NO: 18095
  misc_feature: Useful for making plants with altered carbohydrate content

SEQ ID NO: 50797 - protein, 370 aa, Arabidopsis thaliana
  misc_feature: Useful for making plants with modulated nitrogen use efficiency
MGKLVLELSKENQLETTDCGVSDHGSPPIKNEEHEAPRYSSDKDTGLPTCRVCQCAESDRRGDAALGFLGITPPVSEPRRSNAGEETVDQRSSVVKSSGFIELISPDGEVFVCANDDIEMGAWQHRDKLLELGCSCKNDLALVHYACALKWFVNHGSTVCEICGKTTENIRTVDFNKVVIALKDYAALRERTADGDPNPVVVNNNTSSSGIDPDAVAAIRRQRLSEISLWFGPHCSTNNNNSSNSAAAGTASSQVTSEQPVGIVNFDILPMESRATKWAVEGTGILLATGLLTVTLAWLIAPRVGKRTAKSGLHILLGGLCALTVVIFFRFVVLTRIRYGPARYWAILFAFWFLVFGIWASRSHASHSST

SEQ ID NO: 50798 - protein, 526 aa, Oryza sativa subsp. japonica; identical to SEQ ID NO: 9538
  misc_feature: Useful for making plants with modulated phosphate use efficiency
  misc_feature (129)..(129): Xaa is any aa, unknown, or other
  misc_feature (262)..(262): Xaa is any aa, unknown, or other
  misc_feature (269)..(269): Xaa is any aa, unknown, or other
  misc_feature (492)..(492): Xaa is any aa, unknown, or other

SEQ ID NO: 50799 - protein, 524 aa, Arabidopsis thaliana
  misc_feature: Useful for making plants with modulated carbohydrate content
  misc_feature: Useful for making plants with modulated phosphate use efficiency
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLVMMILCSVASGLSFGHEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPKQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIVGAFGFLYAAQSQDKAKVDAGYPPGIGVKNSLIMLGVLNFIGMLFTFLVPEPKGKSLEELSGEAEVSHDEK

SEQ ID NO: 50800 - protein, 863 aa, Panicum virgatum; identical to SEQ ID NO: 3384
  misc_feature: Useful for making plants with altered carbohydrate content

SEQ ID NO: 50801 - protein, 882 aa, Panicum virgatum; identical to SEQ ID NO: 6628
  misc_feature: Useful for making plants with altered carbohydrate content

SEQ ID NO: 50802 - protein, 174 aa, Arabidopsis thaliana; identical to SEQ ID NO: 9240
  misc_feature: Useful for making plants with altered lignin content

SEQ ID NO: 50803 - protein, 454 aa, Arabidopsis thaliana
  misc_feature: Useful for making plants with modulated nitrogen use efficiency
MEAGERRNGDSMSHNHRAPKKPRLAGLLTESDIDSEFAHHQTGVARINNGSFGCCPGSVLEAQREWQLRYLRQPDEFYFNGLRRGLLASRTVISDLINADDVDEVSLVDNATTAAAIVLQKVGRCFSEGKYKKEDTVVMFHCAFQSVKKSIQAYVSRVGGSTVEVRLPFPVNSNEEIISKFREGLEKGRANGRTVRLAIIDHITSMPCVLMPVRELVKICREEGVEQVFVDAAHAIGSVKVDVKEIGADYYVSNLHKWFFCPPSIAFFYCKKRGSESDVHHPVVSHEFGNGLPIESAWIGTRDYSSQLVVPSVMEFVNRFEGGMEGIMMKNHDEAVRMGLMLADAWGTNLGSPPEMCVGMVMIGLPSKLCVGSDEDAIKLRSYLRVHYSVEVPVFYLGLRDGEEGVKDKDSGLITAYVRISHQVYNKTEDYERLRDAITELVKDQMTCQNLPAL

SEQ ID NO: 50804 - protein, 482 aa, Arabidopsis thaliana
  misc_feature: Useful for making plants with modulated nitrogen use efficiency
MASNLVEMFNAALNWVTMILESPSARVVLFGVPIRGHFFVEGLLGVVIIILLTRKSYKPPKRPLTEQEIDELCDEWVPEPLIPPITEDMKHEPPVLESAAGPHTTVNGKDVVNFASANYLGLIGHEKLLESCTSALEKYGVGSCGPRGFYGTIDVHLDCETRISKFLGTPDSILYSYGLSTMFSTIPCFCKKGDVIVADEGVHWGIQNGLQLSRSTIVYFKHNDMESLRITLEKIMTKYKRSKNLRRYIVAEAVYQNSGQIAPLDEIVKLKEKYRFRVILDESNSFGVLGRSGRGLAEHHSVPIEKIDVVTAAMGHALATEGGFCTGNARIIDYQRLSSSGYVFSASLPPYLASAAITAIDVIDQNPDMLVKLKQNVALLWKGLSDIKGMSLTSNRESPIVFLKLEKSSGSAKDDLLLLEKMADRALKEDSLLVVSSKRSFLDKCRLPVGIKLYVSAGHSESDLLKASESLKRLASELLLKS

SEQ ID NO: 50805 - protein, 413 aa, Panicum virgatum; identical to SEQ ID NO: 7292
  misc_feature: Useful for making plants with altered carbohydrate content

SEQ ID NO: 50806 - protein, 196 aa, Arabidopsis thaliana
  misc_feature: Useful for making plants with modulated low light sensitivity
  misc_feature: Useful for making plants with modulated nitrogen use efficiency
MESADSGRSDPVKGDDPGPSFVSSPPATPSRYESQKRRDWNTFLQYLKNHKPPLALSRCSGAHVIEFLKYLDQFGKTKVHVAACPYFGHQQPPSPCSCPLKQAWGSLDALIGRLRAAYEENGGRPDSNPFAARAVRIYLREVRESQAKARGIPYEKKKRKRPPTVTTVRVDVASSRQSDGDPCNVGAPSVAEAVPP

SEQ ID NO: 50807 - protein, 190 aa, Arabidopsis thaliana
  misc_feature: Useful for making plants with modulated flowering time
  misc_feature: Useful for making plants with modulated low light sensitivity
  misc_feature: Useful for making plants with modulated nitrogen use efficiency
MDLISHQPNKNPNSSTQLTPPSSSRYENQKRRDWNTFCQYLRNHRPPLSLPSCSGAHVLEFLRYLDQFGKTKVHHQNCAFFGLPNPPAPCPCPLRQAWGSLDALIGRLRAAYEENGGPPEANPFGSRAVRLFLREVRDFQAKARGVSYEKKRKRVNRQKPQTQPPLQLQQQQQQPQQGQSMMANYSGATV

SEQ ID NO: 50808 - protein, 195 aa, Arabidopsis thaliana
  misc_feature: Useful for making plants with modulated biomass
  misc_feature: Useful for making plants with modulated flowering time
  misc_feature: Useful for making plants with modulated low light sensitivity
MASHSNKGKGIAEGSSQPQSQPQPQPHQPQSPPNPPALSRYESQKRRDWNTFCQYLRNQQPPVHISQCGSNHILDFLQYLDQFGKTKVHIHGCVFFGQVEPAGQCNCPLKQAWGSLDALIGRLRAAFEENGGLPERNPFAGGGIRVFLREVRDSQAKARGVPYKKRKKRKKRNPMKSHDGEDGTTGTSSSSNLAS

SEQ ID NO: 50809 - protein, 191 aa, Arabidopsis thaliana
  misc_feature: Useful for biocontainment applications
MSSDRHTPTKDPPDHPSSSSNHHKQPLPPQPQQPLSRYESQKRRDWNTFVQYLKSQNPPLMMSQFDYTHVLSFLRYLDQFGKTKVHHQACVFFGQPDPPGPCTCPLKQAWGSLDALIGRLRAAYEEHGGGSPDTNPFANGSIRVHLREVRESQAKARGIPYRKKKRRKTKNEVVVVKKDVANSSTPNQSFT

SEQ ID NO: 50810 - protein, 500 aa, Zea mays; identical to SEQ ID NO: 9302
  misc_feature: Useful for making plants with modulated nitrogen use efficiency

SEQ ID NO: 50811 - protein, 208 aa, Arabidopsis thaliana
  misc_feature: Useful for making plants with altered cell wall content and/or composition
MSDAGFFLDAIDVAANRTMRSFYSQLVSLQGIQKNLDPSCTHAFFPEPSLCFFPQYVLRFIKTPFFILNSAYDVFQFHHGLVPPSADQTGRWNRCKLNVTACNPHQLDALQGFRKDMLGALMNFFRNSTRGGMFINSCFDHCQSALEETWLSPTSPRINNKTIAETVGDWYFGRGEEAKEIGCPYPCDKTCHNLIPASTSDFLVNLDI

SEQ ID NO: 50812 - protein, 75 aa, Arabidopsis thaliana
  misc_feature: Useful for making plants with modulated heat sensitivity
MRRIPRIKFPQRHSISSGSGPAPGSVSGVKKNVTASSDVPAAPKNTADGGKASLQPKRTPVSDKEIESIMLGGCI

SEQ ID NO: 50813 - protein, 357 aa, Arabidopsis thaliana
  misc_feature: Useful for making plants with modulated biomass
MKPVFCGNFEYDARESDLERLFRKYGKVERVDMKAGFAFVYMEDERDAEDAIRALDRFEYGRTGRRLRVEWTKNDRGGAGRSGGSRRSSSGLRPSKTLFVINFDAQNTRTRDLERHFEPYGKIVNVRIRRNFAFIQYEAQEDATRALDATNSSKLMDKVISVEYAVKDDDSRGNGYSPERRRDRSPDRRRRSPSPYRRERGSPDYGRGASPVAHKRERTSPDYGRGRRSPSPYKRARLSPDYKRDDRRRERVASPENGAVRNRSPRKGRGESRSPPPYEKRRESRSPPPYEKRRESRSPPPYEKRRERSRSRSKSSPENGQVESPGQIMEVEAGRGYDGADSPIRESSPSRSPPAEE

SEQ ID NO: 50814 - protein, 138 aa, Arabidopsis thaliana; identical to SEQ ID NO: 9365
  misc_feature: Useful for making plants with modulated drought sensitivity

SEQ ID NO: 50815 - protein, 496 aa, Arabidopsis thaliana
  misc_feature: Useful for making plants with modulated heat sensitivity
MADTVEKVPTVVESSSSSTVEASNSAEKTEPTTEKKKWGDVEDDDDEEEAVSELNSLSIKEEEKPDSILEEPEDSNIKAVTSGDTPYTSASRFEDLNLSPELMKGLYVEMKFEKPSKIQAISLPMIMTPPHKHLIAQAHNGSGKTTCFVLGMLSRVDPTLREPQALCICPTRELANQNMEVLQKMGKFTGITAELAVPDSTRGAPAATRGAPVSAHVVIGTPGTLKKWMAFKRLGLNHLKILVFDEADHMLATDGFRDDSLKIMKDIGRVNPNFQVLLFSATFNETVKDFVARTVKDPNQLFVKREDLALDSVKQYKVVCPKEQNKIEVIKDQIMELGDIGQTIIFVKTKASAQKVHKALAEMGYDVTSVHGNLTESDRDKIVKEFKECLTQVLIATDVIARGFDQQRVNLVVNYNLPTKYETGEPDYEVYLHRVGRAGRFGRKGAVFNLLLDDGWDKEVMEKIEKYFEANVKEIKSWNSEEEYKSALKEAGLLDE

SEQ ID NO: 50816 - protein, 932 aa, Arabidopsis thaliana; identical to SEQ ID NO: 9567
  misc_feature: Useful for making plants with modulated cold sensitivity
  misc_feature: Useful for making plants with modulated heat sensitivity

SEQ ID NO: 50817 - protein, 287 aa, Arabidopsis thaliana
  misc_feature: Useful for making plants with altered cell wall content and/or composition
MACFATKQPLLLSLLLAIGFFVVAASAGNFYESFDITWGNGRANIFENGQLLTCTLDKVSGSGFQSKKEYLFGKIDMKLKLVAGNSAGTVTAYYLSSKGTAWDEIDFEFLGNRTGHPYTIHTNVFTGGKGDREMQFRLWFDPTADFHTYTVHWNPVNIIFLVDGIPIRVFKNNEKNGVAYPKNQPMRIYSSLWEADDWATEGGRVKIDWSNAPFKASYRNFNDQSSCSRTSSSKWVTCEPNSNSWMWTTLNPAQYGKMMWVQRDFMIYNYCTDFKRFPQGLPKECKL

SEQ ID NO: 50818 - protein, 154 aa, Panicum virgatum
  misc_feature: Useful for making plants with altered carbohydrate content
MARRVSSLLLLLLLGALAAAAAASFDQDFDITWGDGRGKIQDGGRLLTLTLDRTSGSGFQSRREYLFGKIDMQIKLVPDNSAGTVTAYYLSSQGSTHDEIDFEFLGNVTGEPYTLHTNVFTQGQGQREQQFRLWFDPTTDFHTYSILWNPKHIM

SEQ ID NO: 50819 - protein, 201 aa, Arabidopsis thaliana
  misc_feature: Useful for making plants with modulated heat sensitivity
MARGRKLTMSQSERYLGSSYSYGDSNGNSATDESELTEEDIWSHAVDHSPEMLESHGAWNTRDAVVRNGRVGGGLSLAFEDASSSPRIVHQIRGGGEGGGGGGGGGRVERQLASSAPVNVPDWSKIYRVNSVESIHESDEEEEEDSGMMMPPHEYLAKSQQRRSRKSGGGGSVFEGVGRTLKGRELRRVRDAIWSQTGFYG

SEQ ID NO: 50820 - protein, 100 aa, Zea mays; identical to SEQ ID NO: 9364
  misc_feature: Useful for making plants with modulated flowering time

SEQ ID NO: 50821 - protein, 397 aa, Zea mays
  misc_feature: Useful for making plants with modulated flowering time
MSSSSASLQPPPAGATGGSSPYSASSSFLPSFMIIAALLAFVFLASVSIHLLLRFLSARSSSSSSTTSSSPPLSGHPRPRTYRDDAGSADASVARRPAATAAPADAGKNEEEEDAGDEKQRLIDSLPLFTMASALAALPKSSPDCAVCLSPFTPDADLRLLPACRHAFHAACVDAWLRTTPSCPLCRAAVALPHPSLSGMLAAAQAQRPARPGPGPGPSFLVEMGTVSSRGSPAAAGGGRDRNRNRNSRTYSLGSAFDYQIDEEVEAVVSRVARIAAARESSAVKEEKPSAEQGSAPAPAPAPSPSSQPPPPGETVAEAAGSSRGWLREYVDRLASSAYTLSERWSSRWSQGQSQQQRQEEPWLWDAEAAEMSAAPGSDDDEEETAFMAMYRWIAGV

SEQ ID NO: 50822 - protein, 209 aa, Zea mays
  misc_feature: Useful for biocontainment applications
  misc_feature: Useful for making plants with modulated flowering time
MDKILERYERYSYAEKALISAESESEGNWCHEYRKLKAKIETIQRCHKHLMGEDLESLNPKELQQLEQQLESSLKHIRSRKSHLMAESISELQKKERSLQEENKALQKELSERQKAVASRQQQQQQLQWDQQTQVQVQTSSSSSSFMMRQDQQGLPPPQNICFPPLSIGERGEEVAAAAQQQLPPPPGQAQPQLRIAGLPPWMLSHLNA

SEQ ID NO: 50823 - protein, 208 aa, Arabidopsis thaliana; identical to SEQ ID NO: 9514
  misc_feature: Useful for making plants with modulated nitrogen use efficiency

SEQ ID NO: 50824 - protein, 166 aa, Arabidopsis thaliana
  misc_feature: Useful for making plants with altered alkaloid content
MAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 50825 - protein, 453 aa, Glycine max
  misc_feature: Useful for making plants with altered cell wall content and/or composition
  misc_feature: Useful for making plants with altered lignin content
  misc_feature: Useful for making plants with altered terpenoid content
  misc_feature: Useful for making plants with modulated biomass
MSLLTVAHQRGSGEFIRFTESHGGGGDDVSGDGEHGCGHDDGSGAGGSLGLNFNQVMQQGEVTMQGGSLVSGYNRGDPELREIVSALTHVVSSGSGQRSTELTQQSGFPMMSASSLSRLSAFSSSSPSPSSGASWVGHKRGREEEENSTSHNLMQQQQQSAPRLFRNIGDFMVPSQGDSSSVTEEAPTSTTTTVTAVTENPPGGGERRRKYRGVRQRPWGKWAAEIRDPHKAARVWLGTFDTEEAAARAYDEAALRFRGNRAKLNFPENVRAVPPIQPFQATTRLTVSDSTTSQFRPLSAVAPPFIQQPQIQGSSDLIRDYLQYSQLLQSDFQQQQIQQQQQQQRQQQQRQRQQRQQQQQQQQQPSSLLQQLYYNAQFASLQSPSMLSSSPSFSSSVSPAPFPLFTTSASFPLFSSQQMGYFQPPESRNPAGGVPEFPTSTWSDTSSQPPPSG

SEQ ID NO: 50826 - protein, 337 aa, Zea mays; identical to SEQ ID NO: 9446
  misc_feature: Useful for making plants with altered lignin content

SEQ ID NO: 50827 - protein, 57 aa, Arabidopsis thaliana
  misc_feature: Useful for making plants with altered cell wall content and/or composition
MKMKLIVVLMVAIVAFSAVGNVAAQTEAPAPSPTSDAAMFVPALFASVAALASGFLF

SEQ ID NO: 50828 - protein, 332 aa, Panicum virgatum; identical to SEQ ID NO: 262
  misc_feature: Useful for making plants with altered carbohydrate content

SEQ ID NO: 50829 - protein, 730 aa, Arabidopsis thaliana
  misc_feature: Useful for making plants with modulated low light sensitivity
MPVRVVESNTPAQAFSGTQNVSNQQKEEAWRVNVQIQGIDLEHGYLCGTMEALNVPMADTPVITFWEGEIVDGKNYTFYTGKWEATREDDMRHWSKFPSFSPLQRWKEQYFVNVGTDCGLTIAGFYYVCFSCSDGSISGFYYDPNSSFHHMIISSSKNVLKMEEVEVSKKRKFQTDQSDELSLLPLSKHTCFANVACSENTNGNSEIDTEYSMSSYVNSTTSMECNNDIEMKEESSGSCGEDKMISFESHLDYIYGTQNLEDFSEKVIENILYLDEQEEEEEDAKGCSSNAAKFVLSSGRWTVNQGKENRILVMPVRVVESNTPAQVSGTDPGNRSPLPPSSLLGAGQAFSGTQNVSNQQKEEAWRVNVQIQGIDLEHGYLCGTMEALNVPMADTPVITFWEGEIVDGKNYTFYTGKWEATREDDMRHWSKFPSFSPLQGQVESDGGRQLDLNNYPYIFMRWKEQYFVNVGTDCGLTIAGFYYVCFSCSDGSISGFYYDPNSSPFQKLELKTVNEGRSGFSFSSYELQMPEVEVDNNNEKPSEINSFHHMIISSSKNVLKMEEVEVSKKRKFQTDQSDELSLLPLSKHTCFANVACSENTNGNSEIDTEYSMSSYVNSTTSMECNNDIEMKEESSGSCGEDKMISFESHLDYIYGTQNLEDFSEKVIENILYLDEQEEEEEDAKGCSSNAAKFVLSSGRWTVNQDDSTLHETKKPTIDQEFEQYFSTLML

SEQ ID NO: 50830 - protein, 146 aa, Arabidopsis thaliana; identical to SEQ ID NO: 9524
  misc_feature: Useful for making plants with modulated cold sensitivity

SEQ ID NO: 50831 - protein, 88 aa, Brassica napus
  misc_feature: Useful for making plants with modulated nitrogen use efficiency
MGRQPCCDKLEVKKGPWTTEEDKKLINFILTNGHCCWRALPKLAGLRRCGKSCRLRWTNYLRPDLKRGLLSHDEEQLVIDLHAHLGNK

SEQ ID NO: 50832 - protein, 265 aa, Arabidopsis thaliana
  misc_feature: Useful for making plants with altered cell wall content and/or composition
  misc_feature: Useful for making plants with altered lignin content
MADGSTSSSESTTACAGSGTRREIMLFGVRVVLDPMRKCVSLNNLSDYEQTAETPKIDGEDRDEQDMNKTPAGYASADEALPMSSSNGKIERKRGVPWTEEEHKLFLLGLQRVGKGDWKGISRNFVKTRTSTQVASHAQKYFLRRSNLNRRRRRSSLFDMTTDTVIPMEEDHQVLIQENTSQSSSPVPEINNFSIHPVMQVFPEFPVPTGNQSYGQLTSSNLINLVPLTFQSSPAPLSLNLSLASSNLNEPSPSMHPAFNTIGVA

SEQ ID NO: 50833 - protein, 314 aa, Arabidopsis thaliana; identical to SEQ ID NO: 9344
  misc_feature: Useful for making plants with modulated nitrogen use efficiency

SEQ ID NO: 50834 - protein, 290 aa, Arabidopsis thaliana
  misc_feature: Useful for making plants with altered alkaloid content
  misc_feature: Useful for making plants with altered lignin content
MAMASASGSALCFTDASSSLALRRDCGALCLPPRTVTFGFVDKPLVNLERLRLSTLKIRASNATAVENGKQEGSAADSDKVPTPVVIIDQDSDPDATVLEVTFGDRLGALLDTMNALKNLGLNVVKANVYLDSSGKHNKFAITRADSGRKVEDPELLEAIRLTVINNLLEFHPESSSQLAMGAAFGVLPPTEPIDVDIATHITIEDDGPDRSLLFIESADRPGLLVELVKIISDISVAVESGEFDTEGLLAKVKFHVSYRNKALIKPLQQVLANSLRYFLRRPSTDESSF

SEQ ID NO: 50835 - protein, 241 aa, Arabidopsis thaliana
  misc_feature: Useful for making plants with modulated nitrogen use efficiency
MAFLVRSPEIPTVSARIFSDANSSVISHVFMRRKATVSAIDARDLPGVKNPKSRLYWQFSAPVKEDYKISREEEEEEEEDKQSYYVNMGHAVRSIREEFPLLFYKELNFDIYRDDIVFKDPMNTFMGIDNYKSIFGALRFHGRIFFRALCVDIVSVWQPTENTLMIRWTVHGIPRGPWETRGRFDGTSEYKFDKNGKIYEHKVDNIAINSPPKFQMLTVQELVEAISCPSTPKPTYFEFGD

SEQ ID NO: 50836 - protein, 257 aa, Panicum virgatum; identical to SEQ ID NO: 19136
  misc_feature: Useful for making plants with altered carbohydrate content

SEQ ID NO: 50837 - protein, 194 aa, Arabidopsis thaliana
  misc_feature: Useful for making plants with altered cell wall content and/or composition
MATVGLSETLFERGQICGACFELRCVDDLRWCIPGTSIILTATNFCAPNYGFDPDGGGHCNPPNKHFVLPIEAFEKIAIWKAGNMPVQYRRINCRKEGSMRFTVDGGGIFISVLITNVAGSGDIAAVKIKGSRTGWLPMGRNWGQNWHINADLRNQALSFEVTSSDRSTVTSYNVSPKNWNYGQTFEGKQFETP

SEQ ID NO: 50838 - protein, 317 aa, Arabidopsis thaliana
  misc_feature: Useful for making plants with modulated water use efficiency
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 50839 - protein, 330 aa, Arabidopsis thaliana
  misc_feature: Useful for making plants with modulated heat sensitivity
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 50840 - protein, 152 aa, Arabidopsis thaliana
  misc_feature: Useful for making plants with modulated nitrogen use efficiency
MEREDLYAVLDLNNECTQGDLRLSYKNLVLKWHPDRFLEEIEKDEAKMKFQSIQRAYSVLSDSNKRLLYDVGAYDSDDDETGMADFINEMVTLMAQTQSTGDENLEEFEELFQELLKDDVNQFKTRSSSSSCSQFSGTSTLVHCDDLSNSND

SEQ ID NO: 50841 - protein, 263 aa, Panicum virgatum; identical to SEQ ID NO: 19206
  misc_feature: Useful for making plants with altered carbohydrate content

SEQ ID NO: 50842 - protein, 254 aa, Arabidopsis thaliana; identical to SEQ ID NO: 9209
  misc_feature: Useful for making plants with altered cell wall content and/or composition
  misc_feature: Useful for making plants with altered lignin content

SEQ ID NO: 50843 - protein, 303 aa, Panicum virgatum
  misc_feature: Useful for making plants with altered carbohydrate content
  misc_feature (265)..(265): Xaa is any aa, unknown, or other
MTVVDAVSAGAGDAAAAVPQPAGNGQTVCVTGAAGYIASWLVKLLLEKGYTVKGTVRNPDDPKNAHLKALDGAAERLILCKADLLDYDAICRAVEGCHGVFHTASPVTDDPEQMVEPAVRGTEYVISAAAEAGTVRRVVFTSSIGAVTMDPNRGADVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFESPAASGRHXCAERVLHREDVVRILAKLFPEYPVPTRYAYVAPSYYGF

SEQ ID NO: 50844 - protein, 355 aa, Arabidopsis thaliana; identical to SEQ ID NO: 9333
  misc_feature: Useful for making plants with altered lignin content
  misc_feature: Useful for making plants with modulated cold sensitivity

SEQ ID NO: 50845 - protein, 359 aa, Arabidopsis thaliana
  misc_feature: Useful for making plants with altered alkaloid content
MISKDPRSSLPPGFRFHPTDEELILHYLRKKVSSSPVPLSIIADVDIYKSDPWDLPAKAPFGEKEWYFFSPRDRKYPNGARPNRAAASGYWKATGTDKLIAVPNGEGFHENIGIKKALVFYRGKPPKGVKTNWIMHEYRLADSLSPKRINSSRSGGSEVNNNFGDRNSKEYSMRLDDWVLCRIYKKSHASLSSPDVALVTSNQEHEENDNEPFVDRGTFLPNLQNDQPLKRQKSSCSFSNLLDATDLTFLANFLNETPENRSESDFSFMIGNFSNPDIYGNHYLDQKLPQLSSPTSETSGIGSKRERVDFAEETINASKKMMNTYSYNNSIDQMDHSMMQQPSFLNQELMMSSHLQYQG

SEQ ID NO: 50846 - protein, 480 aa, Panicum virgatum; identical to SEQ ID NO: 5384
  misc_feature: Useful for making plants with altered carbohydrate content

SEQ ID NO: 50847 - protein, 405 aa, Arabidopsis thaliana; identical to SEQ ID NO: 9337
  misc_feature: Useful for making plants with modulated biomass
  misc_feature (67)..(67): Xaa is any aa, unknown, or other
  misc_feature (68)..(68): Xaa is any aa, unknown, or other
  misc_feature (233)..(233): Xaa is any aa, unknown, or other
  misc_feature (269)..(269): Xaa is any aa, unknown, or other

SEQ ID NO: 50848 - protein, 272 aa, Zea mays; identical to SEQ ID NO: 9290
  misc_feature: Useful for making plants with altered protein content

SEQ ID NO: 50849 - protein, 263 aa, Arabidopsis thaliana; identical to SEQ ID NO: 9182
  misc_feature: Useful for biocontainment applications
  misc_feature: Useful for making plants with altered alkaloid content

SEQ ID NO: 50850 - protein, 289 aa, Arabidopsis thaliana; identical to SEQ ID NO: 9429
  misc_feature: Useful for biocontainment applications

SEQ ID NO: 50851 - protein, 368 aa, Arabidopsis thaliana; identical to SEQ ID NO: 9725
  misc_feature: Useful for making plants with modulated biomass

SEQ ID NO: 50852 - protein, 289 aa, Panicum virgatum; identical to SEQ ID NO: 1114
  misc_feature: Useful for making plants with altered carbohydrate content

SEQ ID NO: 50853 - protein, 185 aa, Arabidopsis thaliana
  misc_feature: Useful for making plants with modulated nitrogen use efficiency
MRTSNHLIGLVNFLTFLLSIPILGGGIWLSSRANSTDCLRFLQWPLIVIGISIMVVSLAGFAGACYRNKFLMWLYLVVMLLIIAALIGFIIFAYAVTDKGSGRTVLNRGYLDYYLEDYSGWLKDRVSDDSYWGKISSCLRDSGACRKIEEILMVYLKLLICSSLEDLALLSPVVASHQQIAVFHM

SEQ ID NO: 50854 - protein, 323 aa, Arabidopsis thaliana; identical to SEQ ID NO: 9258
  misc_feature: Useful for making plants with modulated heat sensitivity

SEQ ID NO: 50855 - protein, 261 aa, Arabidopsis thaliana
  misc_feature: Useful for making plants with altered terpenoid content
MRGRSYTPSPPRGYGRRGRSPSPRGRFGGSRDSDLPTSLLVRNLRHDCRQEDLRRPFEQFGPVKDIYLPRDYYTGDPRGFGFIQFMDPADAAEAKHQMDGYLLLGRELTVVFAEENRKKPTEMRTRDRGGRSNRFQDRRRSPPRYSRSPPRRGRRSRSRSCGYNSPPAKRHQSRSVSPQDRRYEKERSYSRSPPHNGSRVRSGSPGRVKSHSRSPRRSVSPRKNRSYTPEQARSQSPVPRQSRSPTPVPRGAQNGDRSPSQ

SEQ ID NO: 50856 - protein, 680 aa, Arabidopsis thaliana
  misc_feature: Useful for making plants with modulated biomass
MSSLISFNFLFLFSFLTSSFTASAQDPFYLNHYCPNTTTYSSNSTYSTNLRTLLSSLSSRNASYSTGFQNATAGKAPDRVTGLFLCRGDVSPEVCRNCVAFSVNQTLNLCPKVREAVFYYEQCILRYSHKNILSTAITNEGEFILSNTNTISPNQKQIDGFTSFVSSTMSEAAGKAANSSRKLYTVNTELTAYQNLYGLLQCTPDLTRADCLSCLQSSINGMALSRIGARLYWPSCTARYELYPFYNESAIETPPLPPPPPPPPPRESLVSTPPISSSSLPGKSGNSTVLVVAVVVLAVLLFIALVGYCFLAKKKKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQIQLDWMQRYNIIGGIARGILYLHQDSRLTIIHRDLKASNILLDADINPKIADFGMARIFGLDQTQDNTSRIVGTYFVVDSSGYMAPEYAMHGQFSMKSDVYSFGVLVLEIISGRKNSSFGESDGAQDLLTHAWRLWTNKKALDLVDPLIAENCQNSEVVRCIHIGLLCVQEDPAKRPAISTVFMMLTSNTVTLPVPRQPGFFIQCRAVKDPLDSDQSTTTKSFPASIDDESITDLYPR

SEQ ID NO: 50857 - protein, 676 aa, Arabidopsis thaliana
  misc_feature: Useful for making plants with altered cell wall content and/or composition
MSFFWLFPFLLHLSFADSLSPLSAPVQNFIHLNHSCPSSILTYSRNSTYFTNLKTLLSSLSSRNASYSTGFQTATAGQAPDRVTGLFLCRGDVSQEVCRNCVAFSVKETLYWCPYNKEVVLYYDECMLRYSHRNILSTVTYDGSAILLNGANISSSNQNQVDEFRDLVSSTLNLAAVEAANSSKKFYTRKVITPQPLYLLVQCTPDLTRQDCLRCLQKSIKGMSLYRIGGRFFYPSCNSRYENYSFYNETATRSSSPPSLPPRSTPQQQLKLAPPPLISERGKGRNSSVIIVVVVPIIALLLLFVAFFSLRAKKTRTNYEREPLTEESDDITTAGSLQFDFKAIEAATNKFCETNKLGQGGFGEVYKGIFPSGVQVAVKRLSKTSGQGEREFANEVIVVAKLQHRNLVRLLGFCLERDERILVYEFVPNKSLDYFIFDSTMQSLLDWTRRYKIIGGIARGILYLHQDSRLTIIHRDLKAGNILLGDDMNAKIADFGMARIFGMDQTEANTRRIVGTYGYMSPEYAMYGQFSMKSDVYSFGVLVLEIISGKKNSNVYQMDGTSAGNLVTYTWRLWSNGSPLELVDPSFRDNYRINEVSRCIHIALLCVQEEAEDRPTMSAIVQMLTTSSIALAVPQRPGFFFRSSKHEQVGLVDRLSINTSALCSVDDASITNVTPR

SEQ ID NO: 50858 - protein, 86 aa, Zea mays; identical to SEQ ID NO: 9439
  misc_feature: Useful for making plants with modulated nitrogen use efficiency

SEQ ID NO: 50859 - protein, 87 aa, Zea mays; identical to SEQ ID NO: 9218
  misc_feature: Useful for making plants with altered terpenoid content
  misc_feature: Useful for making plants with modulated nitrogen use efficiency

SEQ ID NO: 50860 - protein, 92 aa, Glycine max; identical to SEQ ID NO: 9215
  misc_feature: Useful for making plants with altered lignin content
  misc_feature: Useful for making plants with modulated nitrogen use efficiency

SEQ ID NO: 50861 - protein, 93 aa, Arabidopsis thaliana
  misc_feature: Useful for making plants with altered lignin content
  misc_feature: Useful for making plants with modulated biomass
  misc_feature: Useful for making plants with modulated nitrogen use efficiency
MSGRRSRSRQSSGTSRISEDQINDLIIKLQQLLPELRDSRRSDKVSAARVLQDTCNYIRNLHREVDDLSERLSELLANSDTAQAALIRSLLTQ

SEQ ID NO: 50862 - protein, 280 aa, Glycine max; identical to SEQ ID NO: 9642
  misc_feature: Useful for making plants with modulated salt sensitivity

SEQ ID NO: 50863 - protein, 285 aa, Arabidopsis thaliana; identical to SEQ ID NO: 9717
  misc_feature: Useful for making plants with modulated drought sensitivity
  misc_feature: Useful for making plants with modulated water use efficiency

SEQ ID NO: 50864 - protein, 431 aa, Arabidopsis thaliana; identical to SEQ ID NO: 9179
  misc_feature: Useful for making plants with altered lignin content
  misc_feature: Useful for making plants with altered sterol content
  misc_feature: Useful for making plants with altered terpenoid content
  misc_feature: Useful for making plants with modulated flowering time

SEQ ID NO: 50865 - protein, 326 aa, Panicum virgatum
  misc_feature: Useful for making plants with altered carbohydrate content
KGSEERLQGRRRSSPSIDTYMQGGGDQGGSLGMDVGFAGGAECSSSSAAAAAAAAAAAEAEERQLLKGEIAVHPLCEQLVTAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEPPMLEGALDMGSDGQDMMGFGPLLPTDSERSLMERVRQELKIELKQGFKSRIEDVREEILRKRRAGKLPGDTTSILKQWWQQHSKWPYPTEDDKAKLVEETSLQLKQINNWFINQRKRNWHNNSQTSTLKSKRKR

SEQ ID NO: 50866 - protein, 350 aa, Panicum virgatum; identical to SEQ ID NO: 5692
  misc_feature: Useful for biocontainment applications
  misc_feature: Useful for making plants with modulated biomass

SEQ ID NO: 50867 - protein, 244 aa, Arabidopsis thaliana; identical to SEQ ID NO: 9424
  misc_feature: Useful for making plants with modulated biomass

SEQ ID NO: 50868 - protein, 524 aa, Arabidopsis thaliana
  misc_feature: Useful for making plants with modulated flowering time
MAHRQLYSYALQPSYAAAASTVSPAPPPPQQPLPPKTGLSSLYGSSADHYFPDTTYRFLARDGSEALSNYSGTLASSSSMYHHLPNTTASHLAYPQLLQHQEVAWPPGVEVPGAASAVEPLPPGVKRTSEALYYPTLLGAHNTIGQTEAWYTTDYFTKRPKLESTSHLPIYPQRAGEKDCTHYMQTRTCKFGESCRFDHPIWVPEGGIPDWKEAPVVPNEEYPERPGEPDCPYYIKTQRCKYGSKCKFNHPREEAAVSVETQDSLPERPSEPMCTFYMKTGKCKFGLSCKFHHPKDIQLPSSSQDIGSSVGLTSEPDATNNPHVTFTPALYHNSKGLPVRSGEVDCPFYLKTGSCKYGATCRYNHPERTAFIPQAAGVNYSLVSSNTANLNLGLVTPATSFYQTLTQPTLGVISATYPQRPGQSECDYYMKTGECKFGERCKFHHPADRLSAMTKQAPQQPNVKLSLAGYPRREGALNCPYYMKTGTCKYGATCKFDHPPPGEVMAKTTSEADAAGATNTDTTQ

SEQ ID NO: 50869 - protein, 362 aa, Arabidopsis thaliana
  misc_feature: Useful for making plants with altered lignin content
MYQSSSSTSSSSQRSSLPGGGGLIRYGSAPGSFLNSVVDEVIGGGSSNARDFTGYQPSSDNFIGNFFTGAADSSSLRSDSTTCGVNNSSDGHKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQYSLPSDTSMNYMDNFMQLPEDSVPCKIRAKRGCATHPRSIAERERRTRISGKLKKLQDLVPNMDKQTSYSDMLDLAVQHIKGLQHQLQNLKKDQENCTCGCSEKPS

SEQ ID NO: 50870 - protein, 540 aa, Arabidopsis thaliana
  misc_feature: Useful for making plants with modulated biomass
MQAVKRSRRHVEEEPTMVEPKTKYDRQLRIWGEVGQAALEEASICLLNCGPTGSEALKNLVLGGVGSITVVDGSKVQFGDLGNNFMVDAKSVGQSKAKSVCAFLQELNDSVNAKFIEENPDTLITTNPSFFSQFTLVIATQLVEDSMLKLDRICRDANVKLVLVRSYGLAGFVRISVKEHPIIDSKPDHFLDDLRLNNPWPELKSFVETIDLNVSEPAAAHKHIPYVVILVKMAEEWAQSHSGNLPSTREEKKEFKDLVKSKMVSTDEDNYKEAIEAAFKVFAPRGISSEVQKLINDSCAEVNSNSSAFWVMVAALKEFVLNEGGGEAPLEGSIPDMTSSTEHYINLQKIYLAKAEADFLVIEERVKNILKKIGRDPSSIPKPTIKSFCKNARKLKLCRYRMVEDEFRNPSVTEIQKYLADEDYSGAMGFYILLRAADRFAANYNKFPGQFDGGMDEDISRLKTTALSLLTDLGCNGSVLPDDLIHEMCRFGASEIHVVSAFVGGIASQEVIKLVTKQFVPMLGTYIFNGIDHKSQLLKL

SEQ ID NO: 50871 - protein, 491 aa, Panicum virgatum
  misc_feature: Useful for making plants with altered carbohydrate content
AAVEVRVREVRDPRFFPILCDPLSRATAEAEVAAGESSRRFPALEGPRPVYGTCCPGAMPRPGTEVRSKALLACTSHAAGSCCGSLLLGSCSTLRNCGTATMVPRMLLLLCFCLLAFPPPGPLAVEAFVGGYGINYGRIANNIPSPDKVVELLKKSKIRNVKIYDSDHNILDAFKGSGLNLVIAIPNELVKDMAANESRSMDWLNQNVKPYLPQTRIVGITVGNEVLGGQDQSLYQPLVDAVKNVYNGLKRLHLEKEIELFTPHSEAVFANSYPPSACVFKEELMPYMKPLLDLFAMIHSPFYVNSYPFLAYISDPEHIDINYALFKPNNGIVDPNTSLHYDNMFDAQIDAAYAALHAAGYDDMEVRVAETGWASSGDQNEAGASSENARTYNFNLRKRLFLRKGTPLKPKRPVKAYIFALFNENQKPGPSSERHYGLFLPDGRISYDIGVSGLLPSSASSSMLSVKKIRAGGWILHYLAMVLLSIFIFGP

SEQ ID NO: 50872 - protein, 294 aa, Arabidopsis thaliana
  misc_feature: Useful for making plants with altered cell wall content and/or composition
MSSNADHAFSWVKENIQSFLPKTRIRGIAIGNEVLGGGDSELAGALLGAAKNVYNALKKMNLEDTVQITTAHSQAVFSDSYPPSSCVFKENVVQFMKPLLEFFQQIGSPFCLNAYPFLAYTYNPKEIDINYALFKPTEGIYDPKTDLHYDNMLDAQIDAAYMALQDAGFKKMEVMITETGWASKGDSDEPAATPENARTYNYNLRKRLAKKKGTPLRPKTVLKAYIFALFNENSKPGKSSETHFGLFKPDGTISYDIGFNNLKSDSPKSLISSSKSARYYVALVISVSAFLLMI

SEQ ID NO: 50873 - protein, 54 aa, Arabidopsis thaliana; identical to SEQ ID NO: 9522
  misc_feature: Useful for making plants with modulated nitrogen use efficiency

SEQ ID NO: 50874 - protein, 615 aa, Phaseolus vulgaris
  misc_feature: Useful for making plants with modulated water use efficiency
MPSPASNTWINTTLPSSCSSPFKDLASTSSSPTTLLPFKKRSSSNTNTITCSLQTLHYPKQYQPTSTSTTTTPTPIKPTTTTTTTTPHRETKPLSDTKQPFPQKWNFLQKAAATGLDMVETALVSHESKHPLPKTADPKVQIAGNFAPVPEHAADQALPVVGKIPKCIDGVYVRNGANPLYEPVAGHHFFDGDGMVHAVKFTNGAASYACRFTETQRLAQEKSLGRPVFPKAIGELHGHSGIARLLLFYARSLFQLVDGSHGMGVANAGLVYFNNHLLAMSEDDLPYHVRITSNGDLTTVGRYDFNGQLNSTMIAHPKLDPVNGDLHALSYDVVQKPYLKYFRFSADGVKSPDVEIPLKEPTMMHDFAITENFVVVPDQQVVFKLTEMITGGSPVVYDKNKTSRFGILDKNAKDANAMRWIDAPECFCFHLWNAWEEPETDEIVVIGSCMTPADSIFNECDESLKSVLSEIRLNLRTGKSTRRPIISDAEQVNLEAGMVNRNKLGRKTQFAYLALAEPWPKVSGFAKVDLFSGEVQKYMYGEEKFGGEPLFLPNGEEEGDGYILAFVHDEKEWKSELQIVNAQNLKLEASIKLPSRVPYGFHGTFIHSKDLRKQA

SEQ ID NO: 50875 - protein, 599 aa, Arabidopsis thaliana; identical to SEQ ID NO: 9187
  misc_feature: Useful for making plants with modulated drought sensitivity

SEQ ID NO: 50876 - protein, 911 aa, Arabidopsis thaliana
  misc_feature: Useful for making plants with modulated heat sensitivity
MNPEKFTHKTNETIATAHELAVNAGHAQFTPLHLAGALISDPTGIFPQAISSAGGENAAQSAERVINQALKKLPSQSPPPDDIPASSSLIKVIRRAQAAQKSRGDTHLAVDQLIMGLLEDSQIRDLLNEVGVATARVKSEVEKLRGKEGKKVESASGDTNFQALKTYGRDLVEQAGKLDPVIGRDEEIRRVVRILSRRTKNNPVLIGEPGVGKTAVVEGLAQRIVKGDVPNSLTDVRLISLDMGALVAGAKYRGEFEERLKSVLKEVEDAEGKVILFIDEIHLVLGAGKTEGSMDAANLFKPMLARGQLRCIGATTLEEYRKYVEKDAAFERRFQQVYVAEPSVPDTISILRGLKEKYEGHHGVRIQDRALINAAQLSARYITGRHLPDKAIDLVDEACANVRVQLDSQPEEIDNLERKRMQLEIELHALEREKDKASKARLIEVRKELDDLRDKLQPLTMKYRKEKERIDEIRRLKQKREELMFSLQEAERRYDLARAADLRYGAIQEVESAIAQLEGTSSEENVMLTENVGPEHIAEVVSRWTGIPVTRLGQNEKERLIGLADRLHKRVVGQNQAVNAVSEAILRSRAGLGRPQQPTGSFLFLGPTGVGKTELAKALAEQLFDDENLLVRIDMSEYMEQHSVSRLIGAPPGYVGHEEGGQLTEAVRRRPYCVILFDEVEKAHVAVFNTLLQVLDDGRLTDGQGRTVDFRNSVIIMTSNLGAEHLLAGLTGKVTMEVARDCVMREVRKHFRPELLNRLDEIVVFDPLSHDQLRKVARLQMKDVAVRLAERGVALAVTDAALDYILAESYDPVYGARPIRRWMEKKVVTELSKMVVREEIDENSTVYIDAGAGDLVYRVESGGLVDASTGKKSDVLIHIANGPKRSDAAQAVKKMRIEEIEDDDNEEMIED

SEQ ID NO: 50877 - protein, 531 aa, Zea mays
  misc_feature: Useful for making plants with modulated biomass
MVQGEESSWRMERAALPLNQALAYGVQAHAAAAAAPPTCFLDFQPAAASAAYFGFGELEEALIHGGGAASAGGGVDPGVIIKNDVAQAKSAAGYLAGAGTGRPPTLEIFPSWPMRHQQQLHSGNSQSVGSTGTDSSSAQNTMSQMELVSPASSAPRQEVMMVTTDDYSYKPGLAAAPAAAAPPSFQQHHPLPLQLHGGEGGGDHDKRKHGSTRKDGKLVDAKTERRLAQNREAARKSRLRKKAYVQQLETSRIRLQQVEHELQRARSQGLFVGGCSAAGDMSSGAAMFDMEYARWLDDDTKRLAELRGGLQAHLLDGNLGLIVEECMQHYDELFQLKAALARSDVFHLLTGSWATPAERCFFWMGGFRPSELLKILIPQLDPLTEQQLLGICNLQQSSEQAEEALAQGLHQLHQSLADTVAAGTLNDGAAAPNYMNIMAVALEKLASLENFYQQADNLRHQTLHQMRRILTTRQAARCFLSIGEYYSRLRALSNLWASRPRDNFIGTESLSPTATELQALHHQQQNQFAGF

SEQ ID NO: 50878 - protein, 531 aa, Arabidopsis thaliana
  misc_feature: Useful for making plants with altered cell wall content and/or composition
MESQLWNWILPLLISSLLISFVAFYGFFVKPKRNGLRHDRKTVSTVTSDVGSVNITGDTVADVIVVGAGVAGSALAYTLGKDKRRVHVIERDLSEPDRIVGELLQPGGYLKLLELGIEDCVEEIDAQRVYGYALFKNGKRIRLAYPLEKFHEDVSGRSFHNGRFIQRMREKAASLPNVQLEQGTVLSLLEENGTIKGVRYKNKAGEEQTAFAALTIVCDGCFSNLRRSLCNPQVEVPSCFVGLVLENCNLPYANHGHVVLADPSPILMYPISSTEVRCLVDVPGQKVPSIANGEMKNYLKTVVAPQMPHEVYDSFIAAVDKGNIKSMPNRSMPASPYPTPGALLMGDAFNMRHPLTGGGMTVALADIVVLRNLLRPLRDLSDGASLCKYLESFYTLRKPVAATINTLANALYQVFCSSENEARNEMREACFDYLGLGGMCTSGPVSLLSGLNPRPLTLVCHFFAVAVYGVIRLLIPFPSPKRIWLGAKLISGASGIIFPIIKAEGVRQMFFPATVPAYYYKAPTVGETKCS

SEQ ID NO: 50879 - protein, 532 aa, Arabidopsis thaliana; identical to SEQ ID NO: 9724
  misc_feature: Useful for making plants with modulated biomass
  misc_feature: Useful for making plants with modulated flowering time

SEQ ID NO: 50880 - protein, 294 aa, Arabidopsis thaliana
  misc_feature: Useful for making plants with altered lignin content
MSCNNGMSFFPSNFMIQTSYEDDHPHQSPSLAPLLPSCSLPQDLHGFASFLGKRSPMEGCCDLETGNNMNGEEDYSDDGSQMGEKKRRLNMEQVKTLEKNFELGNKLEPERKMQLARALGLQPRQIAIWFQNRRARWKTKQLEKDYDTLKRQFHTLKAENDLLQTHNQKLQAEIMGLKNREQTESINLNKETEGSCSNRSDNSSDNLRLDISTAPPSNDSTLTGGHPPPPQTVGRHFFPPSPATATTTTTTMQFFQNSSSGQSMVKEENSISNMFCAMDDHSGFWPWLDQQQYN

SEQ ID NO: 50881 - protein, 599 aa, Arabidopsis thaliana; identical to SEQ ID NO: 9187
  misc_feature: Useful for making plants with modulated water use efficiency

SEQ ID NO: 50882 - protein, 585 aa, Arabidopsis thaliana
  misc_feature: Useful for making plants with modulated biomass
  misc_feature: Useful for making plants with modulated light quality response
  misc_feature: Useful for making plants with modulated low light sensitivity
MDVMKLDHDSVLKELERITSKAAEVQDNILRGILERNKDTEYLSKYMNGSKDVLEFKRAVPIIIYKDIYPYIQRIANGEDSSLITGHSITEILCSSGTSAGEPKLMPTIPEDLDRRTFLYNLIIPIVNKYITGLDKGKAMYLNFVKAETSTPCGLPIRAVLTSYYKSKHFQCRPYDPFNDLTSPIQTILCEDSNQSMYCQLLAGLIHRHKVMRLGAVFASAFLRAISYLEKKWSQLCEDIRTGSLNPMITDPGCQMAMSCLLMSPNPELASEIEEICGRSSWKGILCQLWPKAKFIEAVVTGSMAQYIPALEFFSQGKIPLVCPMYASSETYFGVNVEPLSKPSDVVFTLLPNMCYFEFIPLGKNGTLSFDLDDDEQVPCDKVVDLVNVKLGRYYELVVTTFAGLYRYRIGDVLQVAGFYNGAPQFRFICRRNVVLSIDLDKTNEEDLHRSITLAKKKLGSNAFLAEYTSYADTSSVPGHYVLFWEIQGHLEPKLMEECCVAVEEELDYIYRQCRTKERSIGALEIRVVKPGTFEKLMDLIISQGGSFNQYKTPRCVKSNSATFKLLNGHVMASFFSPRDPTWVP

SEQ ID NO: 50883 - protein, 410 aa, Arabidopsis thaliana
  misc_feature: Useful for making plants with altered sterol content
MGSLGTMLRYPDDIYPLLKMKRAIEKAEKQIPPEPHWGFCYSMLHKVSRSFSLVIQQLNTELRNAVCVFYLVLRALDTVEDDTSIPTDEKVPILIAFHRHIYDTDWHYSCGTKEYKILMDQFHHVSAAFLELEKGYQEAIEEITRRMGAGMAKFICQEVETVDDYDEYCHYVAGLVGLGLSKLFLAAGSEVLTPDWEAISNSMGLFLQKTNIIRDYLEDINEIPKSRMFWPREIWGKYADKLEDLKYEENTNKSVQCLNEMVTNALMHIEDCLKYMVSLRDPSIFRFCAIPQIMAIGTLALCYNNEQVFRGVVKLRRGLTAKVIDRTKTMADVYGAFYDFSCMLKTKVDKNDPNASKTLNRLEAVQKLCRDAGVLQNRKSYVNDKGQPNSVFIIMVVILLAIVFAYLRAN

SEQ ID NO: 50884 - protein, 633 aa, Panicum virgatum; identical to SEQ ID NO: 19790
  misc_feature: Useful for making plants with altered carbohydrate content

SEQ ID NO: 50885 - protein, 537 aa, Arabidopsis thaliana
  misc_feature: Useful for making plants with altered cell wall content and/or composition
MVRLKTSLWVLLLALVSIQLNGSFGSESSKVAYVTLLYGDEFLLGVRVLGKSIRDTGSTKDMVALVSDGVSDYSKKLLKADGWKVEKISLLANPNQVHPTRFWGVYTKLKIFNMTDYKKVVYLDADTIVVKNIEDLFKCSKFCANLKHSERLNSGVMVVEPSEALFNDMMRKVKTLSSYTGGDQGFLNSYYPDFPNARVFDPSVTPEVLKTRPVPAMERLSTLYNADVGLYMLANKWMVDDSKLHVIHYTLGPLKPWDWWTAWLVKPVDAWHSIRVKLEETLPGTGGGSNQHDELVVKFLFLLPLCALLFCIYRSIQGREGSLCWSSFSNQIRYLYYKVRSNGTLGYGGVSTMSPSYQPHSGNAQSKVPQHLGAVSVVVCFTAVLLSLGISFAIVPRQIMPWTGLVLVYEWTFTIFFLLFGVFLLFVHQHGKRIAIQSESSSLDDSAKVHQRAGGSCDVTTLYYGLGMAFLAIAAVSLPYILGITALFTRLGLMVGLAIILAAFMTYASEHLAVRWFLKGLEDRRDTTRSNSLCFLC

SEQ ID NO: 50886 - protein, 105 aa, Arabidopsis thaliana
  misc_feature: Useful for making plants with modulated biomass
  misc_feature: Useful for making plants with modulated nitrogen use efficiency
MEDFGRQRPYGDGGMQIQPYHGNQGGDFRSYSASYGTRENNIYDVKKEKSIARSKSWGITDPELQRKKRVASYKMYGVEGKVKGSFRNSFRWLKQRYTQVVYGWW

SEQ ID NO: 50887 - protein, 873 aa, Zea mays
  misc_feature: Useful for making plants with altered lignin content
  misc_feature (432)..(432): Xaa is any aa, unknown, or other
MFGNIGKIPIIGDLTGSNKNAHLKGNVVLVRKTVLGLDVTSIAGSLLDGVGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPYRDDELRNLRGDDQQGPYQEHDRVYRYDVYNDLGLPDSGNPRPVLGGTKELPYPRRCRTGRKPTKSDPNSESRLTLVDGDVYVPRDERFGHIKKSDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPLLVKRLTEFPPRSSLDPSKYGDHTSTIREADLENKLEGLTVQQALHGNRXYILDHHDNFMPFLVRVNSLEGNFIYATRTVLFLRGDGTLVPVAIELSLPELRDGLITAKSSVYTPKSTTGAEAWVWHLAKAYANVNDYCWHQLISHWLNTHAVMEPFVIATNRQLSVTHPVHKLLLPHYRDTMNINSNARQMLVNAGGIFETTVFPRQYAFEMSSVIYKDWNFTEQALPDDLIKRGMAVADPSSPYKVRLLVEDYPYASDGLAIWHAIEQWVTEYLAVYYPNDGVLRADVELQAWWKEAHEVGHADLKDAPWWPKMQTVAELVKACTTIIWIASALHAAVNFGQYPYAGYLPNRPSVSRKPMPAPGSDEYAELERKPEKVFVRTITSQFQALVGISLLEILSSHSSDEVYLGQRDTKEWTSDAKAQEAFKRFGARLTEIEKRVVTMNADPRLKNRNGPAEFPYTLLYPNTSDTKGDAAGITAKGIPNSISI

SEQ ID NO: 50888 - protein, 1173 aa, Arabidopsis thaliana; identical to SEQ ID NO: 9496
  misc_feature: Useful for making plants with modulated flowering time

SEQ ID NO: 50889 - protein, 1173 aa, Arabidopsis thaliana; identical to SEQ ID NO: 9496
  misc_feature: Useful for making plants with modulated biomass

SEQ ID NO: 50890 - protein, 491 aa, Panicum virgatum; identical to SEQ ID NO: 3102
  misc_feature: Useful for making plants with altered carbohydrate content

SEQ ID NO: 50891 - protein, 377 aa, Panicum virgatum; identical to SEQ ID NO: 1714
  misc_feature: Useful for making plants with altered carbohydrate content

SEQ ID NO: 50892 - protein, 361 aa, Arabidopsis thaliana
  misc_feature: Useful for making plants with altered cell wall content and/or composition
MLWIMRFSGLFSAALVIIVLSPSLQSFPPAEAIRSSHLDAYLRFPSSDPPPHRFSFRKAPVFRNAADCAAADIDSGVCNPSLVHVAITLDFEYLRGSIAAVHSILKHSSCPESVFFHFLVSETDLESLIRSTFPELKLKVYYFDPEIVRTLISTSVRQALEQPLNYARNYLADLLEPCVRRVIYLDSDLIVVDDIAKLWMTKLGSKTIGAPEYCHANFTKYFTPAFWSDERFSGAFSGRKPCYFNTGVMVMDLERWRRVGYTEVIEKWMEIQKSDRIYELGSLPPFLLVFAGEVAPIEHRWNQHGLGGDNVRGSCRDLHPGPVSLLHWSGSGKPWFRLDSRRPCPLDTLWAPYDLYGHYSR

SEQ ID NO: 50893 - protein, 706 aa, Arabidopsis thaliana
  misc_feature: Useful for making plants with modulated biomass
  misc_feature: Useful for making plants with modulated flowering time
MILMITAPVCPPHLLLRHSSLLRHESSIGNFHRKKNPRFRTVSCSSLLPQPSVRPDKASELKTLWKKFYKVASPYWFSEDKDQARLRLAAVFALTLATTGISVGFNFLGRDFYNSLANKDQEQFTKQLFYYLCAFAGGIPFFVLRDYTKETLSLRWRSWMTKYYLQRYLKDQTFYKIQSQSIIDNPDQRLVDDLSSFTGTALSFSLTLVNATIDLISFSNILFTIYPPLFLVLLLYSFGGTAISVFLGKGLVNLNFLQEKKEADFRYSLVRVRENAESIAFYGGEQNEMQLLLQRFRSAFDNLTELLIASRNLEFFTDGYRYLIQILPVAVVAPMYFSGKIEFGVINQSVSAFNHILGDFSLVVYQFQAISSFSAVIDRLGEFDDLLDNNIFRDPSDTVDEIELTYQSEMNSSLLDTNGSIKSQPNQKRLEIEELTLQTPTNGTTLVHNLSADVYDKDHLLIMGPSGSGKTSLLRAMAGLWRSGKGKITFYLDPEVDFTQEKSDTQENSGKRGDVLFLPQRPYMVLGSLRQQLLYPTWSATVEETTPGGSNIDGSPPLLIREDGNEKPTTDDLMRTLEKVCLGHIADRFGGLDSIHEWSSVLSLGEQQRLAFARLLLSQPKLALLDESTSALDEANEAFLYQQIQSAGITYISIGHRRTLTKFHNKILQISTADPKSNERNWRIEDVDAQDSLYGRLNQKEVPSES

SEQ ID NO: 50894 - protein, 533 aa, Arabidopsis thaliana
  misc_feature: Useful for making plants with modulated biomass
MKRDHHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRKVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 50895 - protein, 362 aa, Arabidopsis thaliana; identical to SEQ ID NO: 9523
  misc_feature: Useful for making plants with modulated phosphate use efficiency

SEQ ID NO: 50896 - protein, 359 aa, Arabidopsis thaliana; identical to SEQ ID NO: 9216
  misc_feature: Useful for making plants with modulated biomass

SEQ ID NO: 50897 - protein, 446 aa, Arabidopsis thaliana
  misc_feature: Useful for making plants with modulated heat sensitivity
MANLVLSECGIRPLPRIYTTPRSNFLSNNNKFRPSLSSSSYKTSSSPLSFGLNSRDGFTRNWALNVSTPLTTPIFEESPLEEDNKQRFDPGAPPPFNLADIRAAIPKHCWVKNPWKSLSYVVRDVAIVFALAAGAAYLNNWIVWPLYWLAQGTMFWALFVLGHDCGHGSFSNDPKLNSVVGHLLHSSILVPYHGWRISHRTHHQNHGHVENDESWHPMSEKIYNTLDKPTRFFRFTLPLVMLAYPFYLWARSPGKKGSHYHPDSDLFLPKERKDVLTSTACWTAMAALLVCLNFTIGPIQMLKLYGIPYWINVMWLDFVTYLHHHGHEDKLPWYRGKEWSYLRGGLTTLDRDYGLINNIHHDIGTHVIHHLFPQIPHYHLVEATEAAKPVLGKYYREPDKSGPLPLHLLEILAKSIKEDHYVSDEGEVVYYKADPNLYGEVKVRAD

SEQ ID NO: 50898 - protein, 298 aa, Oryza sativa; identical to SEQ ID NO: 9649
  misc_feature: Useful for making plants with modulated silicon content

SEQ ID NO: 50899 - protein, 239 aa, Arabidopsis thaliana
  misc_feature: Useful for making plants with altered lignin content
MADSPQRRRDSRSPSPRKERARSRSRSRSRSRSRPRLRSRSRSLPRPVSPSRSRGRSRSRSRGRSEVENPGTTLYVTGLSTRVTDKDLEAHFAKEGKVASCFLVMEPRTRVSRGFAFVTMSSLKDAERCIKYLNQSVLEGRYITVERSRRKRPRTPTPGHYLGLKSSRDSDREGRSSRGRHYDRDDYRDRRSPRRDYSPRDERRSRRDRSYSPHGRSPERRSERRSERSERRYEPRGSR

SEQ ID NO: 50900 - protein, 822 aa, Panicum virgatum; identical to SEQ ID NO: 20186
  misc_feature: Useful for making plants with altered carbohydrate content

SEQ ID NO: 50901 - protein, 942 aa, Arabidopsis thaliana
  misc_feature: Useful for making plants with altered cell wall content and/or composition
MSSSSQAMLQKSDSIAEKMPDALKQSRYHMKRCFASFVGGGKKLMKREHLMNEIEKCIEDSRERSKILEGLFGYILTCTQEAAVVPPFVALAARPNPGFWEYVKVNSGDLTVDEITATDYLKLKESVFDESWSKDENALEIDFGAIDFTSPRLSLSSSIGKGADYISKFISSKLGGKSDKLEPLLNYLLRLNHHGENLMINDDLNTVAKLQKSLMLAVIVVSTYSKHTPYETFAQRLKEMGFEKGWGDTAERVKETMIILSEVLEAPDNGKLDLLFSRLPTVFNVVIFSVHGYFGQQDVLGLPDTGGQVVYILDQVRALEEELLIRINQQGLGFKPQILVVTRLIPEARGTKCDQELEAIEGTKHSHILRVPFVTNKGVLRQWVSRFDIYPYLERFTQDATSKILQRLDCKPDLIIGNYTDGNLVASLMATKLGVTQGTIAHALEKTKYEDSDAKWKELDPKYHFSCQFTADLIAMNVTDFIITSTYQEIAGSKDRPGQYESHTAFTMPGLCRVVSGIDVFDPKFNIAAPGADQSVYFPYTEKDKRFTKFHPSIQELLYNEKDNAEHMGYLADREKPIIFSMARLDTVKNITGLVEWYGKDKRLREMANLVVVAGFFDMSKSNDREEKAEIKKMHDLIEKYKLKGKFRWIAAQTDRYRNSELYRCIADTKGVFVQPALYEAFGLTVIEAMNCGLPTFATNQGGPAEIIVDGVSGFHIDPNNGDESVTKIGDFFSKCRSDGLYWDNISKGGLKRIYECYTWKIYAEKLLKMGSLYGFWRQVNEDQKKAKKRYIEMLYNLQFKQLTKKVTIPEDKPLPLRLASLRNLLPKKTTNLGAGSKQKEVTETEKTKQKSKDGQEQHDVKVGEREVREGLLAADASERVKKVLESSEEKQKLEKMKIAYGQQHSQGASPVRNLFWSVVVCLYICYILKQRFFGANSAQEY

SEQ ID NO: 50902 - protein, 328 aa, Panicum virgatum
  misc_feature: Useful for making plants with altered carbohydrate content
MYAVTLSSGLFLLEKYAAAVSVAAAGVILGWPFSILVFLPVTVYSLIRGPFGRVFLSGFLTSVSLLVLSFLADYHCYGRWTFSVFNLLKYNVLGGGESHLYGTEGPSFYFRNGFNNFNFAFILALLFLGVVPFARKKYAPDLLMVVSPVYIWLAFMSLQAHKEERFLYPIYTLICVAAASVIDIFPDFFHDKYSSDQSIFEKIAKGLRPLILGFILCASHSRTFSMLNGYGAPLQIYQHLEYHENSGPRSILCVGSEWHRYPSSFFIPSYISEVRWIDDGFRGLLPFPFNETLGGTTAAPAYFNNKNKASEEQYVFSILLKFHKAIFF

SEQ ID NO: 50903 - protein, 293 aa, Panicum virgatum
  misc_feature: Useful for making plants with altered carbohydrate content
MARRVSLLLLGALAACSAAAAASFDQEFDITWGDGRGKIQDGGRLLTLTLDRTSGSGFQSRHEYLFGKIDMQLKLVPGNSAGTVTAYYLSSQGSAHDEIDFEFLGNVSGEPYTLHTNVFTQGQGQRKQQFRLWFDPTTDFHTYSILWNPKHIIFMVDDLPIRDFRNLESKGIAFPKSQPMRLYSSLWNADDWATQGGRVKTDWSHAPFSASYRGFRADACVTVAGGRTRCGAAVGTEGAAGAAAPAGDWYNQELDLTLQQRMRWVQRKYMIYNYCTDPKRYQQGLPAECSMQQ

SEQ ID NO: 50904 - protein, 277 aa, Arabidopsis thaliana
  misc_feature: Useful for making plants with altered cell wall content and/or composition
LSLLFTLTVSTTTLFSPVFAGTFDTEFDITWGDGRGKVLNNGELLTLSLDRASGSGFQTKKEYLFGKIDMQLKLVPGNSAGTVTAYYLKSKGDTWDEIDFEFLGNLTGDPYTMHTNVYTQGKGDREQQFHLWFDPTADFHTYSVLWNPHHIVFMVDDIPVREFKNLQHMGIQYPKLQPMRLYSSLWNADQWATRGGLVKTDWSKAPFTASYRNFRADACVSSGGRSSCPAGSPRWFSQRLDLTAEDKMRVVQRKYMIYNYCTDTKRFPQGFPKECRH

SEQ ID NO: 50905 - protein, 292 aa, Arabidopsis thaliana
  misc_feature: Useful for making plants with altered cell wall content and/or composition
  misc_feature: Useful for making plants with altered lignin content
MAKIYSPSFPGTLCLCIFTLLTLMFIRVSARPATFVEDFKAAWSESHIRQMEDGKAIQLVLDQSTGCGFASKRKYLFGRVSMKIKLIPGDSAGTVTAFYMNSDTATVRDELDFEFLGNRSGQPYSVQTNIFAHGKGDREQRVNLWFDPSMDYHTYTILWSHKHIVFYVDDVPIREYKNNEAKNIAYPTSQPMGVYSTLWEADDWATRGGLEKIDWSKAPFYAYYKDFDIEGCPVPGPTFCPSNPHNWWEGYAYQSLNAVEARRYRWVRVNHMVYDYCTDRSRFPVPPPECRA

SEQ ID NO: 50906 - protein, 297 aa, Arabidopsis thaliana
  misc_feature: Useful for making plants with modulated water use efficiency
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 50907 - protein, 408 aa, Panicum virgatum; identical to SEQ ID NO: 6264
  misc_feature: Useful for making plants with altered carbohydrate content

SEQ ID NO: 50908 - protein, 348 aa, Arabidopsis thaliana
  misc_feature: Useful for making plants with modulated biomass
MESLAHIPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKKLTTMNYNNPRTMMGSSSGQESNWFTQQMDVGNGNYYHLPDLESPRMFQGSSSSSLSSLHQNDQDPYGVVLSTINATPTTIMQRDDGHVITNDDDHMIMMNTSTGDHHQSGLLVNDDHNDQVMDWQTLDKFVASQLIMSQEEEEVNKDPSDNSSNETFHHLSEEQAATMVSMNASSSSSPCSFYSWAQNTHT

SEQ ID NO: 50909 - protein, 416 aa, Arabidopsis thaliana
  misc_feature: Useful for making plants with modulated salt sensitivity
MGASGKWVKSIIGLKKLEKDEIEKGNGKNKKWKLWRTTSVDSWKGFRGKHRSDSDGVDSSTVYSAAVATVLRAPPKDFKAVREEWAAIRIQTAFRGFLARRALRALKGIVRLQALVRGRQVRKQAAVTLRCMQALVRVQARVRARRVRMTVEGQAVQKLLDEHRTKSDLLKEVEEGWCDRKGTVDDIKSKLQQRQEGAFKRERALAYALAQKQWRSTTSSNLKTNSSISYLKSQEFDKNSWGWSWLERWMAARPWETRLMDTVDTAATPPPLPHKHLKSPETADVVQVRRNNVTTRVSAKPPPHMLSSSPGYEFNESSGSSSICTSTTPVSGKTGLVSDNSSSQAKKHKPSYMSLTESTKAKRRTNRGLRQSMDEFQFMKNSGMFTGELKTSPSSDPFVSFSKPLGVPTRFEKPRG

SEQ ID NO: 50910 - protein, 262 aa, Arabidopsis thaliana
  misc_feature: Useful for making plants with modulated drought sensitivity
MSDKDYKEPPPAPFFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAHVTPREVVLELRSLAHSFLYTQSSQQLTPREMLVTLMSLFLHHSQSGLRFSWFTWQPSQSLAQASTQLEALELQSSTTKTIPGMTTGCFGLAPSLELHLLLFTMWLSSEPSPSSPEAK

SEQ ID NO: 50911 - protein, 221 aa, Arabidopsis thaliana; identical to SEQ ID NO: 9475
  misc_feature: Useful for making plants with modulated drought sensitivity

SEQ ID NO: 50912 - protein, 324 aa, Arabidopsis thaliana
  misc_feature: Useful for making plants with altered lignin content
MEVDEDIELQKHQEQQSRKLQRFSEDNTGLMRNWNNPSSRIIRVSRASGGKDRHSKVLTSKGLRDRRIRLSVATAIQFYDLQDRLGFDQPSKAVEWLINAASDSITDLPLLNTNFDHLDQNQNQTKSACSSGTSESSLLSLSRTEIRGKARERARERTAKDRDKDLQNAHSSFTQLLTGGFDQQPSNRNWTGGSDCFNPVQLQIPNSSSQEPMNHPFSFVPDYNFGISSSSSAINGGYSSRGTLQSNSQSLFLNNNNNITQRSSISSSSSSSSPMDSQSISFFMATPPPLDHHNHQLPETFDGRLYLYYGEGNRSSDDKAKERR

SEQ ID NO: 50913 - protein, 222 aa, Panicum virgatum; identical to SEQ ID NO: 1070
  misc_feature: Useful for making plants with altered carbohydrate content

SEQ ID NO: 50914 - protein, 223 aa, Arabidopsis thaliana; identical to SEQ ID NO: 9503
  misc_feature: Useful for making plants with altered alkaloid content

SEQ ID NO: 50915 - protein, 224 aa, Arabidopsis thaliana
  misc_feature: Useful for making plants with altered lignin content
MSSSSYNTSVIPSSSSSAQPFFITSSGTGDNDFNRKDTFMSMIQQPNSSAPPPKKRRNQPGNPNPDAEVVALSPKTLMATNRFICDVCNKGFQREQNLQLHRRGHNLPWKLKQKSTKEVKRKVYLCPEPTCVHHDPSRALGDLTGIKKHYYRKHGEKKWKCEKCSKRYAVQSDWKAHSKTCGTKEYRCDCGTIFSRFPFLRNSSSFVDPLLISFSLYVCLYIRT

SEQ ID NO: 50916 - protein, 94 aa, Zea mays; identical to SEQ ID NO: 9393
  misc_feature: Useful for making plants with modulated nitrogen use efficiency

SEQ ID NO: 50917 - protein, 261 aa, Arabidopsis thaliana
  misc_feature: Useful for making plants with modulated biomass
MSGLRRLDGKIAIITGGASGIGAEAVRLFTDHGAKVVIVDIQEELGQNLAVSIGLDKASFYRCNVTDETDVENAVKFTVEKHGKLDVLFSNAGVLEAFGSVLDLDLEAFDRTMAVNVRGAAAFIKHAARSMVASGTRGSIVCTTSIAAEIGGPGPHSYTASKHALLGLIRSACAGLGQYGIRVNGVAPYGVATGMTSAYNEEAVKMLEEYGEALGNLKGVVLKARHIAEAALFLASDDSVYISGQNLVVDGGFSVVKLMST

SEQ ID NO: 50918 - protein, 236 aa, Arabidopsis thaliana; identical to SEQ ID NO: 9231
  misc_feature: Useful for making plants with modulated nitrogen use efficiency

SEQ ID NO: 50919 - protein, 273 aa, Arabidopsis thaliana; identical to SEQ ID NO: 9327
  misc_feature: Useful for making plants with modulated nitrogen use efficiency
  misc_feature: Useful for making plants with modulated oxidative stress sensitivity

SEQ ID NO: 50920 - protein, 387 aa, Panicum virgatum; identical to SEQ ID NO: 20523
  misc_feature: Useful for making plants with altered carbohydrate content

SEQ ID NO: 50921 - protein, 392 aa, Arabidopsis thaliana
  misc_feature: Useful for making plants with altered cell wall content and/or composition
MATHSLSFFFRVLLLLFLTLSERIKGQGVGINYGQIANNLPSPARVAVLLRSLNITRVKLYDADPNVLFSFSNSQVDFMIGLGNEYLQNMSTDPTKAQDWLQQRLEPHISKTRITSIVVGNEIFKTNDHVLIQSLLPAMKSVYAALTNLGLEKQVTVTSAHSLDILSTSYPPSSGSFKEEFIQYLQPLLDFHSQIESPFLINAYPFFAYKDSPKEVPLEYVLFQPNQGMVDPNTNLHYDNMLFAQVDALYSAIKTLGHTDIEVRISETGWPSKGDENEIGASPENAALYNGNLLKLIQQRKGTPAKQSVPIDVYVFALFNENLKPGPVSERNYGLFYPDGKPVYNVGMQGYLPDIIYTSRATTIKILNLWRVVMGLAVAWFILDMGDKMRMR

SEQ ID NO: 50922 - protein, 425 aa, Arabidopsis thaliana; identical to SEQ ID NO: 9235
  misc_feature: Useful for making plants with altered cell wall content and/or composition
  misc_feature: Useful for making plants with altered lignin content

SEQ ID NO: 50923 - protein, 329 aa, Zea mays; identical to SEQ ID NO: 9375
  misc_feature: Useful for making plants with modulated biomass

SEQ ID NO: 50924 - protein, 439 aa, Panicum virgatum; identical to SEQ ID NO: 3350
  misc_feature: Useful for making plants with altered carbohydrate content

SEQ ID NO: 50925 - protein, 534 aa, Panicum virgatum; identical to SEQ ID NO: 20531
  misc_feature: Useful for making plants with altered carbohydrate content

SEQ ID NO: 50926 - protein, 304 aa, Arabidopsis thaliana
  misc_feature: Useful for making plants with modulated biomass
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEKKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQLAAHLTGIHSAIKMLNSRIRVLYQNLAAMQKGDKSCDNSVLRQVSSLLRRLPAMESERFQDNFYDGVQRQITNNLPSDDYKLFQQHERDGRQIQHRI

SEQ ID NO: 50927 - protein, 407 aa, Arabidopsis thaliana
  misc_feature: Useful for making plants with altered alkaloid content
  misc_feature: Useful for making plants with altered lignin content
MMKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNADKRPRMKGRFVKRSSIGVAH

SEQ ID NO: 50928 - protein, 483 aa, Arabidopsis thaliana
  misc_feature: Useful for making plants with modulated biomass
MERKVLNTLAFSVFAVLFFTSSASSQYQTLVVNTLPSSATLSWPESESLTDESLSESTTSLSVHLSHVDALSSFSDASPADLFNLRLQRDSLRVKSITSLAAVSTGRNATKRTPRTAGGFSGAVISGLSQGSGEYFMRLGVGTPATNVYMVLDTGSDVVWLQCSPCKACYNQTDAIFDPKKSKTFATVPCGSRLCRRLDDSSECVTRRSKTCLYQVSYGDGSFTEGDFSTETLTFHGARVDHVPLGCGHDNEGLFVGAAGLLGLGRGGLSFPSQTKNRYNGKFSYCLVDRTSSGSSSKPPSTIVFGNAAVPKTSVFTPLLTNPKLDTFYYLQLLGISVGGSRVPGVSESQFKLDATGNGGVIIDSGTSVTRLTQPAYVALRDAFRLGATKLKRAPSYSLFDTCFDLSGMTTVKVPTVVFHFGGGEVSLPASNYLIPVNTEGRFCFAFAGTMGSLSIIGNIQQQGFRVAYDLVGSRVGFLSRAC

SEQ ID NO: 50929 - protein, 394 aa, Arabidopsis thaliana
  misc_feature: Useful for making plants with modulated nitrogen use efficiency
MGSFGMLSRRTLGTDMPVMAQIRSLMAELTNPMSLAQGVVHWQPPQKALEKVKELVWDPIISSYGPDEGLPELRQALLKKLREENKLTNSQVMVTAGANQAFVNLVITLCDAGDSVVMFEPYYFNSYMAFQMTGVTNIIVGPGQSDTLYPDADWLERTLSESKPTPKVVTVVNPGNPSGTYVPEPLLKRIAQICKDAGCWLIVDNTYEYFMYDGLKHCCVEGDHIVNVFSFSKTYGMMGWRLGYIAYSERLDGFATELVKIQDNIPICAAIISQRLAVYALEEGSGWITERVKSLVKNRDIVKEALEPLGKENVKGGEGAIYLWAKLPEGHRDDFKVVRWLAHRHGVVVIPGCASGSPGYLRVSFGGLQEVEMRAAAARLRKGIEELLHHGMVE

SEQ ID NO: 50930 - protein, 385 aa, Glycine max
  misc_feature: Useful for making plants with modulated biomass
MESPQSVVSPFKRSVLGDAEKYRSDVLSKDIEVNGKEGAVCNVEEFIGVVDVYIHQARDIHNICIYHKQDVYAKICLTSNPENTVSTKTINGGGRNPVFNENLSLSVRTVDSVVKCEIWMLSRVKNYLEDQLLGFALVPLSEVLVKKDGKLEKEFSLSSTDLFHSPAGYVQLSLAYTGASPDVMAISSMPTTEKDSESCESLVRDLDKIEFPDPKIVNEDHLMVSEYFGIPCEESQCSDSLTTTDTENLSSEAGVQLVESFSACSVSSVSTNGVSSPSVAASSDSSPNEETKEKNVDVKDGETDSSFPKPLVTVNIEPEPNVVQQDFVDMYMKSMQQFTESLAKMKLPVDFESGPTSSGNSSSEHKLQTPKSTNSRVFYGSRAFF

SEQ ID NO: 50931 - protein, 590 aa, Panicum virgatum; identical to SEQ ID NO: 1012
  misc_feature: Useful for making plants with altered carbohydrate content

SEQ ID NO: 50932 - protein, 705 aa, Arabidopsis thaliana
  misc_feature: Useful for making plants with modulated flowering time
MSQPLTTRPTVTGISIIPFRQPPPLCSFLFVIVLFVATFYTLHHPDAVTPPLLFSRNAYNALRLRRLFLSSASNATISSYLRELTRHPHLAGTKPSLDTLHYVFNHFQSLGLETHVAEYEALLSYPTHISVTASFSNTTTLEFDLNDVPGDSPVVRPYHAYSPSGSAQGNVVFVNHGEERDYHALESIGVSVKGCVVLARKGENLGRGAIVKIAEAKGALGVLIYAENDGGGFGGIERGTVMRGIGDPVSPGWPGVVGGEKLSLDDELVTRRFPKIPSLPLSLRNAEIILASLGGARAPLEWRNSGRVGPGQRVGPGRMVINMTFQGEMKMKKINNVVVTIRGSEEADRYVILGNHRDAWTYGAVDPNSGTSALLDISRRFALLLKSGWRPRRTILLCSWDAEEFGMIGSTEWIEENVLNLGASAVAYLNVDCAVQGSGFFAGATPQLDGLLVDVLKLVQDPDAVGLTVEETFKSQNNIIQRLSRVDSDFSGFLHHAGIPSIDMYYGADYPVYHTAFDSYDWMIHNADPLFHRHVAMAGIWGLLGILLADEPLIPFDYISYADQLQAHRDKLSKLLEGKVSVNPLSMAIQEFSLVAKEAADEAKKLKGKSYSKNDVAAAAKRRELNDRLMLVERGFLDAEGIKGKEWFKHLVYGPAAEPESKLGFFPGIADAIAMNASEGIIEHEIWRVARAIQRASKALKGGFT

SEQ ID NO: 50933 - protein, 356 aa, Arabidopsis thaliana
  misc_feature: Useful for making plants with modulated biomass
  misc_feature: Useful for making plants with modulated flowering time
  misc_feature (8)..(8): Xaa is any aa, unknown, or other
  misc_feature (209)..(209): Xaa is any aa, unknown, or other
  misc_feature (213)..(213): Xaa is any aa, unknown, or other
  misc_feature (214)..(214): Xaa is any aa, unknown, or other
  misc_feature (225)..(225): Xaa is any aa, unknown, or other
  misc_feature (228)..(228): Xaa is any aa, unknown, or other
  misc_feature (229)..(229): Xaa is any aa, unknown, or other
  misc_feature (243)..(243): Xaa is any aa, unknown, or other
  misc_feature (244)..(244): Xaa is any aa, unknown, or other
  misc_feature (245)..(245): Xaa is any aa, unknown, or other
  misc_feature (253)..(253): Xaa is any aa, unknown, or other
  misc_feature (259)..(259): Xaa is any aa, unknown, or other
  misc_feature (262)..(262): Xaa is any aa, unknown, or other
  misc_feature (273)..(273): Xaa is any aa, unknown, or other
  misc_feature (280)..(280): Xaa is any aa, unknown, or other
  misc_feature (284)..(284): Xaa is any aa, unknown, or other
  misc_feature (293)..(293): Xaa is any aa, unknown, or other
  misc_feature (302)..(302): Xaa is any aa, unknown, or other
  misc_feature (311)..(311): Xaa is any aa, unknown, or other
  misc_feature (318)..(318): Xaa is any aa, unknown, or other
  misc_feature (322)..(322): Xaa is any aa, unknown, or other
  misc_feature (328)..(328): Xaa is any aa, unknown, or other
  misc_feature (333)..(333): Xaa is any aa, unknown, or other
  misc_feature (336)..(336): Xaa is any aa, unknown, or other
  misc_feature (343)..(343): Xaa is any aa, unknown, or other
  misc_feature (352)..(352): Xaa is any aa, unknown, or other
MSIVAKLXLNKGMSPHVLVAYRMAVASALITPFALILERNTRPKLTFKILLQIAILSLFEPVVEQNLYYSGMKLTTATFTSALCNALPAMTFIMACVFKLEKVTIERRHSQAKLVGTMVAIGGAMLMTFVKGNVIELPWTSNSRGLNGHTHAMRIPKQADIARGSIMLVASCFSWSCYIILQAKILAQYKAELSLTALMCIMGMLEATXMGLXXERKNMSVWKIXPDXXLLASIYGGLVSGLXXXVIGWASKXRGPVFXSAXNPLSMVLVAIXSTFVFLXKVYXGRVIGSVVXVIGIYLVLXGKSKDKGGXLQPNAGXAETXVKIDQXKVPTXDNXQVVSISXHLMIPKAAXRSQE

SEQ ID NO: 50934 - protein, 472 aa, Panicum virgatum; identical to SEQ ID NO: 3172
  misc_feature: Useful for making plants with altered carbohydrate content

SEQ ID NO: 50935 - protein, 524 aa, Arabidopsis thaliana
  misc_feature: Useful for making plants with altered alkaloid content
MATVKDSGFEALEKLKATEPPVFLAPSSISEDARSASQYLFMKLKPHNPKCPFDQLSSDGFDAEQIWQQIDMQSQPLLTSLRQEVKRFAKNPEEIRKLGKLALKVSHEDDIDEMDMDGFDSDDVDDEDKEIESNDSEGEDEEEEEEDEEEEEEEEEEEEEEKDGDNEGIEDKFFKIKELEEFLEEGEAEEYGIDHKNKKGVAQRKKQNLSDDEDEEDDDDEEEDVEFDAFAGGDDEETDKLGKARYDDFFGGKKETKMKLKDLSEDEEAEIENKGNEKLSTHERARLKLQSKIEQMEKANLDPKHWTMQGEITAAKRPMNSALEVDLDFEHNARPAPVITEEVTASLEDLIKSRIIEARFDDVQRAPRLPTKGKREAKELDESKSKKGLAEVYEAEYFQKANPAFAPTTHSDELKKEASMLFKKLCLKLDALSHFHFTPKPVIEEMSIPNVSAIAMEEVAPVAVSDAAMLAPEEIFSGKGDIKDESELTQEDRKRRRANKKRKFKAESANEPPKKALDTSTKNP

SEQ ID NO: 50936 - protein, 426 aa, Panicum virgatum; identical to SEQ ID NO: 3004
  misc_feature: Useful for making plants with altered carbohydrate content

SEQ ID NO: 50937 - protein, 433 aa, Arabidopsis thaliana; identical to SEQ ID NO: 9220
  misc_feature: Useful for making plants with altered cell wall content and/or composition
  misc_feature: Useful for making plants with altered lignin content

SEQ ID NO: 50938 - protein, 416 aa, Arabidopsis thaliana; identical to SEQ ID NO: 9426
  misc_feature: Useful for making plants with modulated drought sensitivity
  misc_feature: Useful for making plants with modulated water use efficiency

SEQ ID NO: 50939 - protein, 525 aa, Arabidopsis thaliana
  misc_feature: Useful for making plants with altered cell wall content and/or composition
MEEKSKSRGWCGWFIAIIVLASVILAVVYTVKLRTKKSGDDDGGGPVPGPPGAIDKKYADALKLALQFFDIQKSGKLENNKIPWRGDSGLKDGSEDNLDLSKGLYDAGDHIKFGFPMAFTATVLSWSILEYGDQMNAVNQLDPAKDSLRWITDYLIKAHPSDNVLYIQVGDPKVDHPCWERPEDMKEKRPLTKIDVDTPGTEVAAETAAAMASASLVFKDSDPTYSATLLKHAKQLFNFADTKRGSYSVNIPEVQKFYNSTGYGDELLWAASWLYHATEDKTYLDYVSNHGKEFASFGNPTWFSWDNKLAGTQVLLSRLLFFKKDLSGSKGLGNYRNTAKAVMCGLLPKSPTSTASRTNGGLIWVSEWNSMQQSVSSAFLASLFSDYMLTSRIHKISCDGKIFKATELRDFAKSQADYMLGKNPLGTSFVVGYGDKYPQFVHHRGASIPADATTGCLDGFKWFNSTKPNPNIAYGALVGGPFFNETFTDSRENPMQNEPTTYNNALLVGLLSSLVTTSSTLQSLK

SEQ ID NO: 50940 - protein, 339 aa, Arabidopsis thaliana
  misc_feature: Useful for making plants with modulated low light sensitivity
  misc_feature: Useful for making plants with modulated nitrogen use efficiency
MCSNKASPVVGEEKQSTRSSKRIKKRKNREATTTMEDKSSSNLDASRKIRTKTKKPKFLSLKLELNTSHEINENPRSKKSKKKNNNKKQSKKKEPDTTPFKEKKRAETTTTLGGGEKEEEQYDTVAAYLFNSATDSTISSIHDLLPSSAATDVDCGGERNNLSPYDRQDHGSSSSSLLRTAMRKGASEEEETTEERWVSYSEVVEEVMSRSGTPRCCGGGDGNDGRPSLALKLDYEQIMEAWSDKGTLYVDGEPPQTVPDLHASADGFNDGGEAGNLWAVPEMETTERLWRGHREASLLRYKEKRQNRLFSKRIRYQVRKLNAEKRPRVKGRFVKREDS

SEQ ID NO: 50941 - protein, 279 aa, Arabidopsis thaliana
  misc_feature: Useful for making plants with altered cell wall content and/or composition
MAVNVDAEYLKEIEKTRRDLRALISSRNCAPIMLRLAWHDAGTYDAKKKTGGANGSIRFKEELNRPHNKGLEKAVAFCEEVKAKHPRVSYADLYQLAGVVAVEVTGGPAIPFTPGRKDADSADDGELPNPNEGASHLRTLFSRMGLLDRDIVALSGGHTLGRAHKERSDFEGPWTQDPLKFDNSYFVELLKGETPGLLQLKTDKALLDDPKFHPFVKLYAKDEDMFFKAYAISHKKLSELGFNPPRRIPSAVTQQTLGIAVAAAVVIFTICYEASRRGK

SEQ ID NO: 50942 - protein, 250 aa, Arabidopsis thaliana
  misc_feature: Useful for making plants with modulated heat sensitivity
MTKNYPTVSEDYKKAVEKCRRKLRGLIAEKNCAPIMVRLAWHSAGTFDCQSRTGGPFGTMRFDAEQAHGANSGIHIALRLLDPIREQFPTISFADFHQLAGVVAVEVTGGPDIPFHPGREDKPQPPPEGRLPDATKGCDHLRDVFAKQMGLSDKDIVALSGAHTLGRCHKDRSGFEGAWTSNPLIFDNSYFKELLSGEKEGLLQLVSDKALLDDPVFRPLVEKYAADEDAFFADYAEAHMKLSELGFADA

SEQ ID NO: 50943 - protein, 251 aa, Arabidopsis thaliana
  misc_feature: Useful for making plants with modulated water use efficiency
MVKKSYPEVKEEYKKAVQRCKRKLRGLIAEKHCAPIVLRLAWHSAGTFDVKTKTGGPFGTIRHPQELAHDANNGLDIAVRLLDPIKELFPILSYADFYQLAGVVAVEITGGPEIPFHPGRLDKVEPPPEGRLPQATKGVDHLRDVFGRMGLNDKDIVALSGGHTLGRCHKERSGFEGAWTPNPLIFDNSYFKEILSGEKEGLLQLPTDKALLDDPLFLPFVEKYAADEDAFFEDYTEAHLKLSELGFADKE

SEQ ID NO: 50944 - protein, 490 aa, Panicum virgatum; identical to SEQ ID NO: 3674
  misc_feature: Useful for making plants with altered carbohydrate content

SEQ ID NO: 50945 - protein, 273 aa, Arabidopsis thaliana
  misc_feature: Useful for making plants with modulated biomass
  misc_feature: Useful for making plants with modulated flowering time
MEDYERINSNSPTHEEDSDVRKGPWTEEEDAILVNFVSIHGDARWNHIARSSGLKRTGKSCRLRWLNYLRPDVRRGNITLEEQFMILKLHSLWGNRWSKIAQYLPGRTDNEIKNYWRTRVQKQAKHLRCDVNSNLFKETMRNVWMPRLVERINAQSLPTTCEQVESMITDPSQPVNEPSPVEPGFVQFSQNHHQQFVPATELSATSSNSPAETFSDVRGGVVNGSGYDPSGQTGFGEFNDWGCVGGDNMWTDEESFWFLQDQFCPDTTSYSYN

SEQ ID NO: 50946 - protein, 236 aa, Arabidopsis thaliana
  misc_feature: Useful for making plants with modulated nitrogen use efficiency
MGRSPCCEKAHTNKGAWTKEEDQRLVDYIRNHGEGCWRSLPKSAGLLRCGKSCRLRWINYLRPDLKRGNFTDDEDQIIIKLHSLLGNKWSLIAGRLPGRTDNEIKNYWNTHIKRKLLSHGIDPQTHRQINESKTVSSQVVVPIQNDAVEYSFSNLAVKPKTENSSDNGASTSGTTTDEDLRQNGECYYSDNSGHIKLNLDLTLGFGSWSGRIVGVGSSADSKPWCDPVMEARLSLL

SEQ ID NO: 50947 - protein, 952 aa, Arabidopsis thaliana
  misc_feature: Useful for making plants with modulated biomass
MDNGGSVLSLSAPHFPYSATILRRHSPVASISFSLKQPPPQPPEPPESPPDLRRPEKSIGSSSSSSSPSPIPSPKTPLKINPLKGLTNRSSVSPLVQSEVSSKVSSFGSSLASKLRLSSKLSPPPPPPPPPPVEETTQFRDEFRSDTKPPEEETRNPQQEFRQEGKIFVGNLPTWIKKPEFEEFFRQFGPIENVILIKGHHEVEKNAGFGFIIYAAEKSAMKAVEFDGVEFHGRILTVKLDDGKRLKTKAEQRVRWVEEGEEDTKMSNKSSWHQEREGSRKSLQRILDTNGDNWQAVISAFEKISKPSRTEFGLMVKFYGRRGDMHRARETFERMRARGITPTSRIYTSLIHAYAVGRDMDEALSCVRKMKEEGIEMSLVTYSVIVGGFSKAGHAEAADYWFDEAKRIHKTLNASIYGKIIYAHCQTCNMERAEALVREMEEEGIDAPIAIYHTMMDGYTMVADEKKGLVVFKRLKECGFTPTVVTYGCLINLYTKVGKISKALEVSRVMKEEGVKHNLKTYSMMINGFVKLKDWANAFAVFEDMVKEGMKPDVILYNNIISAFCGMGNMDRAIQTVKEMQKLRHRPTTRTFMPIIHGYAKSGDMRRSLEVFDMMRRCGCVPTVHTFNGLINGLVEKRQMEKAVEILDEMTLAGVSANEHTYTKIMQGYASVGDTGKAFEYFTRLQNEGLDVDIFTYEALLKACCKSGRMQSALAVTKEMSARNIPRNSFVYNILIDGWARRGDVWEAADLIQQMKKEGVKPDIHTYTSFISACSKAGDMNRATQTIEEMEALGVKPNIKTYTTLIKGWARASLPEKALSCYEEMKAMGIKPDKAVYHCLLTSLLSRASIAEAYIYSGVMTICKEMVEAGLIVDMGTAVHWSKCLCKIEASGGELTETLQKTFPPDWSSHHHHHGFLDQVSDVDSDEDDVDGEDGEDDEDVNSVSDLLSPYK

SEQ ID NO: 50948 - protein, 631 aa, Arabidopsis thaliana
  misc_feature: Useful for making plants with altered terpenoid content
MSCSYLLSGDASVVASRRWSDVSSRQRLFLPRQSLRQPSGSSFSRCVRLVANVNDHFSKQSLATRNCLASVFSADLGGSNGNNDNGNGGGGGGDGGGDNSDDSSFDLRYLCFLLLGLSCFFHFRLSAASAIAKDQNSDSNGDAVKETVWEVRGSKRKRLVPDFVKDEFVSEESAFELSSSLTPENLLAQCRNLLTQFLLPEGFPNSVTSDYLDYSLWRGVQGIASQISGVLATQSLLYAVGLGKGAIPTAAAINWVLKDGIGYLSKIMLSKYGRHFDVHPKGWRLFADLLENAAFGMEMLTPVFPQFFVMIGAAAGAGRSAAALIQAATRSCFNAGFASQRNFAEVYNNFYMALVLITYQQLFVFLNYSGSLGEAQGMVSKSVGILLGIVVANCIGTSTSLALAAFGVVTTIHMYTNLKSYQCIQLRTLNPYRASLVFSEYLISGQAPLIKEVNDEEPLFPTVRFSNMKSPEKLQDFVLSSEAKAAAADIEERLQLGSKLSDVIHNKEEAIALFDLYRNEGYILTEHKGRFCVMLKESSTPQDMLRSLFQVNYLYWLEKNAGIEPASTYSDCKPGGRLHISLDYVRREFEHAKEDSESVGWVTEGLIARPLPTRIRLGHDRELLLSSPNSS

SEQ ID NO: 50949 - protein, 366 aa, Panicum virgatum; identical to SEQ ID NO: 3138
  misc_feature: Useful for making plants with altered carbohydrate content

SEQ ID NO: 50950 - protein, 490 aa, Arabidopsis thaliana
  misc_feature: Useful for making plants with modulated nitrogen use efficiency
MAEEPTTTTLVTPEKLPSPSLTPSEVSESTQDALPTETETLEKVTETNPPETADTTTKPEEETAAEHHPPTVTETETASTEKQEVKDEASQKEVAEEKKSMIPQNLGSFKEESSKLSDLSNSEKKSLDELKHLVREALDNHQFTNTPEEVKIWGIPLLEDDRSDVVLLKFLRAREFKVKDSFAMLKNTIKWRKEFKIDELVEEDLVDDLDKVVFMHGHDREGHPVCYNVYGEFQNKELYNKTFSDEEKRKHFLRTRIQFLERSIRKLDFSSGGVSTIFQVNDMKNSPGLGKKELRSATKQAVELLQDNYPEFVFKQAFINVPWWYLVFYTVIGPFMTPRSKSKLVFAGPSRSAETLFKYISPEQVPVQYGGLSVDPCDCNPDFSLEDSASEITVKPGTKQTVEIIIYEKCELVWEIRVTGWEVSYKAEFVPEEKDAYTVVIQKPRKMRPSDEPVLTHSFKVNELGKVLLTVDNPTSKKKKLVYRFNVKPL

SEQ ID NO: 50951 - protein, 318 aa, Panicum virgatum; identical to SEQ ID NO: 5004
  misc_feature: Useful for making plants with altered carbohydrate content

SEQ ID NO: 50952 - protein, 325 aa, Arabidopsis thaliana
  misc_feature: Useful for making plants with altered cell wall content and/or composition
MEKNTSQTIFSNFFLLLLLSSCVSAQLRTGFYQNSCPNVETIVRNAVRQKFQQTFVTAPATLRLFFHDCFVRGCDASIMIASPSERDHPDDMSLAGDGFDTVVKAKQAVDSNPNCRNKVSCADILALATREVVVLTGGPSYPVELGRRDGRISTKASVQSQLPQPEFNLNQLNGMFSRHGLSQTDMIALSGAHTIGFAHCGKMSKRIYNFSPTTRIDPSINRGYVVQLKQMCPIGVDVRIAINMDPTSPRTFDNAYFKNLQQGKGLFTSDQILFTDQRSRSTVNSFANSEGAFRQAFITAITKLGRVGVLTGNAGEIRRDCSRVN

SEQ ID NO: 50953 - protein, 457 aa, Arabidopsis thaliana
  misc_feature: Useful for making plants with altered cell wall content and/or composition
MGQDGSPAHKRPSGSGGGLPTTTLTNGGGRGGRGGLLPRGRQMQKTFNNIKITILCGFVTILVLRGTIGVGNLGSSSADAVNQNIIEETNRILAEIRSDSDPTDLDEPQEGDMNPNATYVLGPKITDWDSQRKVWLNQNPEFPSTVNGKARILLLTGSPPKPCDNPIGDHYLLKSVKNKIDYCRLHGIEIVYNMAHLDKELAGYWAKLPMIRRLMLSHPEVEWIWWMDSDALFTDILFQIPLARYQKHNLVIHGYPDLLFDQKSWIALNTGSFLLRNCQWSLDLLDAWAPMGPKGPIRDEAGKVLTAYLKGRPAFEADDQSALIYLLLSQKDTWMEKVFVENQYYLHGFWEGLVDRYEEMIEKYHPGLGDERWPFVTHFVGCKPCGSYADYAVERCLKSMERAFNFADNQVLKLYGFSHRGLLSPKIKRIRNETVSPLEFVDKFDIRRTPVETKPQN

SEQ ID NO: 50954 - protein, 450 aa, Panicum virgatum; identical to SEQ ID NO: 7408
  misc_feature: Useful for making plants with altered carbohydrate content

SEQ ID NO: 50955 - protein, 532 aa, Arabidopsis thaliana
  misc_feature: Useful for making plants with altered cell wall content and/or composition
MINNHPIREKPKHIIFNLLSLIFFLIFLSTVVSSQSPSYTTHKTQRLTETKTIPELIIADLNLTILKVNLASSNFSDLQTRLFPNLTHYERCAFEDCLGLLDDTISDLETAVSDLRSSSLEFNDISMLLTNVMTYQDTCLDGFSTSDNENNNDMTYELPENLKEIILDISNNLSNSLHMLQVISRKKPSPKSSEVDVEYPSWLSENDQRLLEAPVQETNYNLSVAIDGTGNFTTINDAVFAAPNMSETRFIIYIKGGEYFENVELPKKKTMIMFIGDGIGKTVIKANRSRIDGWSTFQTPTVGVKGKGYIAKDISFVNSAGPAKAQAVAFRSGSDHSAFYRCEFDGYQDTLYVHSAKQFYRECDIYGTIDFIFGNAAVVFQNSSLYARKPNPGHKIAFTAQSRNQSDQPTGISILNCRILAAPDLIPVKENFKAYLGRPWRKYSRTVIIKSFIDDLIHPAGWLEGKKDFALETLYYGEYMNEGPGANMAKRVTWPGFRRIENQTEATQFTVGPFIDGSTWLNSTGIPFSLGF

SEQ ID NO: 50956 - protein, 336 aa, Arabidopsis thaliana
  misc_feature: Useful for making plants with altered cell wall content and/or composition
MSRRIREDISIRLFDPKMITIALFLVLLYFHDQLGYSAAQLQFGFYSETCPSAESIVRDVVQQAVTNDPGKAAVLLRLQFHDCFVEGCDGSILIKHGGNDDERFAAGNAGVAGFDVIDEAKSELERFCPGVVSCADIVALAARDAIAEAKGPFYEVPTGRRDGLIANVDHAKNLPDVQDSINTLKSKFREKGLSDQDLVLLSAGAHTIGTTACFFVIPRLDAQDPTINPEFFQILRSKCPQGGDVNVRIPLDWDSQFVFDNQIFQNIKNGRGVILSDSVLYQDNNMKKIIDSYLETNQSSKANFAADFTKAMIKMGAIGVKIGAEGEIRRLCSATN

SEQ ID NO: 50957 - protein, 261 aa, Panicum virgatum; identical to SEQ ID NO: 3564
  misc_feature: Useful for making plants with altered carbohydrate content

SEQ ID NO: 50958 - protein, 257 aa, Arabidopsis thaliana
  misc_feature: Useful for making plants with altered cell wall content and/or composition
MAMLGLVLSVLTTILALSEARIPGVYNGGGWETAHATFYGGSDASGTMGGACGYGNLYSQGYGVNTAALSTALFNNGFSCGACFELKCASDPKWCHSGSPSIFITATNFCPPNFAQPSDNGGWCNPPRPHFDLAMPMFLKIAEYRAGIVPVSFRRVPCRKRGGIRFTINGFRYFNLVLVTNVAGAGNIVRLGVKGTHTSWMTMSRNWGQNWQSNSVLVGQSLSFRVTSSDRRSSTSWNIAPANWKFGQTFMGKNFRV

SEQ ID NO: 50959 - protein, 419 aa, Arabidopsis thaliana
  misc_feature: Useful for making plants with altered cell wall content and/or composition
MFSFGRARSQGRQNRSMSLGGLDYADPKKKNNYLGKILLTASLTALCIFMLKQSPTFNTPSVFSRHEPGVTHVLVTGGAGYIGSHAALRLLKESYRVTIVDNLSRGNLAAVRILQELFPEPGRLQFIYADLGDAKAVNKIFTENAFDAVMHFAAVAYVGESTQFPLKYYHNITSNTLVVLETMAAHGVKTLIYSSTCATYGEPDIMPITEETPQVPINPYGKAKKMAEDIILDFSKNSDMAVMILRYFNVIGSDPEGRLGEAPRPELREHGRISGACFDAARGIMPGLQIKGTDYKTADGTCVRDYIDVTDLVDAHVKALQKAKPRKVGIYNVGTGKGSSVKEFVEACKKATGVEIKIDYLPRRAGDYAEVYSDPSKIRKELNWTAKHTNLKESLETAWRWQKLHRNGYGLTTSSVSVY

SEQ ID NO: 50960 - protein, 375 aa, Arabidopsis thaliana; identical to SEQ ID NO: 9526
  misc_feature: Useful for making plants with modulated nitrogen use efficiency

SEQ ID NO: 50961 - protein, 405 aa, Zea mays; identical to SEQ ID NO: 9576
  misc_feature: Useful for making plants with modulated endosperm cell number
  misc_feature: Useful for making plants with modulated endosperm size

SEQ ID NO: 50962 - protein, 214 aa, Panicum virgatum; identical to SEQ ID NO: 6752
  misc_feature: Useful for making plants with altered carbohydrate content

SEQ ID NO: 50963 - protein, 217 aa, Arabidopsis thaliana
  misc_feature: Useful for making plants with altered cell wall content and/or composition
MKMTAKMRREFPTAFLLLFLVPVMIPVGEAVWLDVPPTGTKCVSEEIQSNVVVLADYLIISEDHEVMPTISVKVTSPYGNNLHNMENVTHGQFAFTTQESGNYLACFWADEKSHGNKNVSINIDWRTGIAAKDWASIAKKEKIEGVELEIRKLEGAVEAIHENILYLRNREADMRTMSEKTNSRVAWYSIMSLGVCIAVSGFQVLYLKQYFEKKKLI

SEQ ID NO: 50964 - protein, 142 aa, Arabidopsis thaliana; identical to SEQ ID NO: 9450
  misc_feature: Useful for making plants with modulated biomass

SEQ ID NO: 50965 - protein, 513 aa, Arabidopsis thaliana; identical to SEQ ID NO: 9177
  misc_feature: Useful for making plants with modulated biomass
  misc_feature: Useful for making plants with modulated heat sensitivity
  misc_feature: Useful for making plants with modulated seed number

SEQ ID NO: 50966 - protein, 547 aa, Panicum virgatum; identical to SEQ ID NO: 3656
  misc_feature: Useful for making plants with altered carbohydrate content

SEQ ID NO: 50967 - protein, 458 aa, Panicum virgatum; identical to SEQ ID NO: 2098
  misc_feature: Useful for making plants with altered carbohydrate content

SEQ ID NO: 50968 - protein, 256 aa, Arabidopsis thaliana
  misc_feature: Useful for making plants with modulated biomass
  misc_feature: Useful for making plants with modulated flowering time
  misc_feature: Useful for making plants with modulated phosphate use efficiency
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQHNQGHNMPPPLPPQQHQIQHPYMLSHQPSPFLNMGGLYQEDDPMAMRRNDLELTLEPVYNCNLGCFAA

SEQ ID NO: 50969 - protein, 251 aa, Zea mays; identical to SEQ ID NO: 9694
  misc_feature: Useful for making plants with altered alkaloid content
  misc_feature: Useful for making plants with modulated flowering time

SEQ ID NO: 50970 - protein, 166 aa, Zea mays
  misc_feature: Useful for making plants with altered alkaloid content
  misc_feature: Useful for making plants with altered terpenoid content
  misc_feature: Useful for making plants with modulated flowering time
MGRGRVELKRIENKINRQVTFSKRRNGLLKKAYELSVLCDAEVALIIFSGRGKLYEFGSAGVTKTLERYQHFCYNAQDSNNGALSESQSWYQEISKLRAKFEALQRTQRHLLGEDLGPLSTVKELQQLEKQLECALSQARQRKTQLMMEQVEELRRTVFYTRLCLQ

SEQ ID NO: 50971 - protein, 107 aa, Arabidopsis thaliana
  misc_feature: Useful for making plants with altered lignin content
MGRGKIEIKRIENANNRVVTFSKRRNGLVKKAKEITVLCDAKVALIIFASNGKMIDYCCPSMDLGAMLDQYQKLSGTNYGMLSMRTLAMRLIGSRKRMIAYNWSSGI

SEQ ID NO: 50972 - protein, 135 aa, Zea mays
  misc_feature: Useful for making plants with modulated nitrogen use efficiency
MAPPPLSSWPWASLGQYKYVLLGPLVWKVLQEWREQAGLPLGSWWLHLLLLFAARGLTYQFWFSYGNMLFFTRRRRVVADGVDFRQIDAEWDWKKILWIPPPNNQPWSPSDTGNAQAHLAGIGRLFFLRLVPAFG

SEQ ID NO: 50973 - protein, 481 aa, Panicum virgatum; identical to SEQ ID NO: 5072
  misc_feature: Useful for making plants with altered carbohydrate content

SEQ ID NO: 50974 - protein, 437 aa, Arabidopsis thaliana
  misc_feature: Useful for making plants with altered cell wall content and/or composition
MSRLDDIPSSPGKFKMEKSSYLHRLRFQSSLTKFAFFSFFLLCLISLLFLRSPPSINPSSPSDPSRRSLRTNTYGGPAWEKRLRSSARIRTSTNNGITVLVTGAAGFVGTHVSAALKRRGDGVIGLDNFNDYYDPSLKRARRALLERSGIFIVEGDINDVELLRKLFKIVSFTHVMHLAAQAGVRYAMENPSSYVHSNIAGFVNLLEICKSVNPQPAIVWASSSSVYGLNTKVPFSEKDKTDQPASLYAATKKAGEEIAHTYNHIYGLSLTGLRFFTVYGPWGRPDMAYFFFTKDILKGKSISIFESANHGTVARDFTYIDDIVKGCLAALDTAEKSTGSGGKKRGPAQLRVFNLGNTSPVPVSDLVRILERQLKVKAKKNLIKMPRNGDVPFTHANISLAQRELGYKPTTDLQTGLKKFVRWYLSYYSGDKKAAAR

SEQ ID NO: 50975 - protein, 268 aa, Glycine max
  misc_feature: Useful for making plants with altered alkaloid content
  misc_feature: Useful for making plants with altered terpenoid content
MVLIEHEESKQRNANPSNAANDDSDGFETASDTDLAGEGDDSGAGIPEEQNRTEQSHTEKQTEQEPEHDAPRSSKSSENNALISEEESRQKALNQANEAKVEGNKLFVEGKYEEALLQYELALQAAPDMPSSVEIRSICHSNRGVCFLKLGKYDNTIKECTKALELNPVYIKALVRRGEAHEKLEHFEEAIADMKKILEIDLSNDQARKTIRQLEPLAAEKREKMKEEMIAKLKDMGNSVLGRFGMSVDNFKAVKDPNTGSYSISFQR

SEQ ID NO: 50976 - protein, 517 aa, Arabidopsis thaliana
  misc_feature: Useful for making plants with modulated salt sensitivity
MGAIDLSFSQSLLFSSSRSNLSSSTHRSVSFLPPGSKSRCLPPLRSMSHDDDTASKEVKLWGGRFEESVTEKVEKFTESISFDKVLYKQDIMGSKAHASMLAHQGLITDSDKDSILRGLDDIERQIEANKFEWRTDREDVHMNIEAALTDLIGEPAKKLHTARSRNDQVATDFRLWCRDAIDTIIVKIRNLQRALVELALKNEALIVPGYTHLQRAQPVLLPHVLLTFVEQLERDAGRYVDCRARLNFSPLGACALAGTGLPIDRFMTANALGFTEPMRNSIDAVSDRDFVLEFLYTNANTGIHLSRLGEEWVLWASEEFGFMTPSDSVSTGSSIMPQKKNPDPMELVRGKSARVIGDLVTVLTLCKGLPLAYNRDFQEDKEPMFDSTKTIMGMIDVSAEFAQNVTFNEDRIKKSLPAGHLDATTLADYLVKKGMPFRSSHDIVGKLVGVCVSKGCELQNLSLEEMKKLSPVFEEDVFGFLGVENSVNKFSSYGSTGSNCVAEQLGYWVNKLNITST

SEQ ID NO: 50977 - protein, 414 aa, Arabidopsis thaliana
  misc_feature: Useful for making plants with modulated salt sensitivity
MVSVLFQSSCSCSLSSFRSVKFGARLVSPLYFAGNHVHVTSGSLPIGKGSLLNLKSERPQRFVISAVVDDKSVVAKEEKKDGSEEVVVDNQRMIKVCDKLIEVFMVDKPTPSDWRRLLAFSKEWDSIRPHFYKRCQERADSEDNPEMKHKVHRLARKLKEVDEDIQRHNELLNVIKRTPPAEIGELVARRRKDFTNEFFEHLHTVAESYYDNPDEQNALASLGKLSIAAVQAYDTSTESIDALNAAEMKLQDIINSPSLDAACRKIDSLAEKNQLDSALVLMITKAWSAAKESNMMKEEVKDILYHLYVTARGNLQRLMPKEVRILKYLLSIEDPQEQISALQDAFTPGDELEGTDVDYLYTTPEHLQSLMKTVLEAYHFSREGSLVKEAKDLMHPELIAKIEQLKKLVEKKYM

SEQ ID NO: 50978 - protein, 485 aa, Panicum virgatum; identical to SEQ ID NO: 5132
  misc_feature: Useful for making plants with altered carbohydrate content

SEQ ID NO: 50979 - protein, 489 aa, Panicum virgatum; identical to SEQ ID NO: 4130
  misc_feature: Useful for making plants with altered carbohydrate content

SEQ ID NO: 50980 - protein, 333 aa, Panicum virgatum; identical to SEQ ID NO: 5466
  misc_feature: Useful for making plants with altered carbohydrate content

SEQ ID NO: 50981 - protein, 433 aa, Panicum virgatum; identical to SEQ ID NO: 692
  misc_feature: Useful for making plants with altered carbohydrate content

SEQ ID NO: 50982 - protein, 445 aa, Arabidopsis thaliana
  misc_feature: Useful for making plants with altered cell wall content and/or composition
MASELINRRHETDQPTADAYYPKPIKPWFTVTRPMRYMLREQRLIFVLVGIAIATLVFTIFPRSTQSTPYSDPFSGYGIRPDESYVPAIQAQRKPSLEYLNRIGATGGKIPLGLKRKGLRVVVTGGAGFVGSHLVDRLMARGDTVIVVDNFFTGRKENVMHHFSNPNFEMIRHDVVEPILLEVDQIYHLACPASPVHYKFNPVKTIITNVVGTLNMLGLAKRVGARFLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNANIEFRPNTEDDPHKRKPDITKAKELLGWEPKVSLRQGLPLMVKDFRQRVFGDQKEGSSAAATTTKTTSA

SEQ ID NO: 50983 - protein, 318 aa, Arabidopsis thaliana
  misc_feature: Useful for making plants with modulated nitrogen use efficiency
  misc_feature: Useful for making plants with modulated salt sensitivity
  misc_feature (39)..(39): Xaa is any aa, unknown, or other
MATVPLFTQFPCKTLNPSSSNTKHQSKSPILLPINSINXRSEIGVSVHRPDFKIRATDIDDEWGQDGVERVFASSSTVSVADKAIESVEETERLKRSLADSLYGTDRGLSVSSDTRAEISELITQLESKNPTPAPNEALFLLNGKWILAYTSFVGLFPLLSRRIEPLVKVDEISQTIDSDSFTVQNSVRFAGPFSTTSFSTNAKFEIRSPKRVQIKFEQGVIGTPQLTDSIEIPESVEVLGQKIDLNPIKGLLTSVQDTASSVARTISNQPPLKFSLPSDNTQSWLLTTYLDKDLRISRGDGGSVYVLIKEGSSLLNP

SEQ ID NO: 50984 - protein, 706 aa, Arabidopsis thaliana
  misc_feature: Useful for making plants with altered cell wall content and/or composition
MCGLAKKLDIEDTLTSLSDQENESLAKPMNDAAEWEHSFSALLEFAADNDVEGFRRQLSDVSCINQMGLWYRRQRFVRRMVLEQRTPLMVASLYGSLDVVKFILSFPEAELNLSCGPDKSTALHCAASGASVNSLDVVKLLLSVGADPNIPDAHGNRPVDVLVVSPHAPGLRTILEEILKKDEIISEDLHASSSSLGSSFRSLSSSPDNGSSLLSLDSVSSPTKPHGTDVTFASEKKEYPIDPSLPDIKSGIYSTDEFRMFSFKIRPCSRAYSHDWTECPFAHPGENARRRDPRKFHYTCVPCPDFKKGSCKQGDMCEYAHGVFECWLHPAQYRTRLCKDGMGCNRRVCFFAHANEELRPLYPSTGSGLPSPRASSAVSASTMDMASVLNMLPGSPSAAQHSFTPPISPSGNGSMPHSSMGWPQQNIPALNLPGSNIQLSRLRSSLNARDIPSEQLSMLHEFEMQRQLAGDMHSPRFMNHSARPKTLNPSNLEELFSAEVASPRFSDQLAVSSVLSPSHKSALLNQLQNNKQSMLSPIKTNLMSSPKNVEQHSLLQQASSPRGGEPISPMNARMKQQLHSRSLSSRDFGSSLPRDLMPTDSGSPLSPWSSWDQTHGSKVDWSVQSDELGRLRKSHSLANNPNREADVSWAQQMLKDSSSPRNGNRVVNMNGARPLTQGGSSVNPHNSDTRESDILDAWLEQLHLDR

SEQ ID NO: 50985 - protein, 321 aa, Arabidopsis thaliana
  misc_feature: Useful for making plants with modulated flowering time
MKLAGLKSIENAHEDSVWAATWVPATEDRPALLLTGSLDETVKLWRPDELDLVRTNTGHSLGVAALAAHPSGIIAASSSIDSFVRVFDVDTNATIAVLEAPPSEVWGMQFEPKGTILAVAGGSSASVKLWDTASWRLISTLSIPRPDAPKPSDKTSSKKFVLSVAWSPNGKRLACGSMDGTICVFDVDRSKLLHQLEGHNMPVRSLVFSPVDPRVLFSGSDDGHVNMHDAEGKTLLGSMSGHTSWVLSVDASPDGGAIATGSSDRTVRLWDLKMRAAIQTMSNHNDQVWSVAFRPPGGTGVRAGRLASVSDDKSVSLYDYS

SEQ ID NO: 50986 - protein, 393 aa, Arabidopsis thaliana
  misc_feature: Useful for making plants with modulated biomass
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 50987 - protein, 397 aa, Arabidopsis thaliana
  misc_feature: Useful for making plants with altered cell wall content and/or composition
MFKLKQWLIYLVCSLVIMNTEGLFVNITFVRNAVAKGAVCLDGSPPAYHLDRGSGTGINSWLIQLEGGGWCNNVTNCVSRMHTRLGSSKKMVENLAFSAILSNKKQYNPDFYNWNRVKVRYCDGASFTGDVEAVNPATNLHFRGARVWLAVMQELLAKGMINAENAVLSGCSAGGLASLMHCDSFRALLPMGTKVKCLSDAGFFLNTRDVSGVQYIKTYFEDVVTLHGSAKNLPRSCTSRLTPAMCFFPQYVARQIRTPLFILNAAYDSWQIKNILAPRAADPYGKWQSCQLDIKNCHPSQIKVMQDFRLEFLSAVIGLGRSSSRGMFIDSCYTHCQTETQTSWFWQDSPILNRTTIAKAVGDWVYDRTLFQKIDCPYPCNPTCHHRVFTPLDAPPI

SEQ ID NO: 50988 - protein, 524 aa, Panicum virgatum; identical to SEQ ID NO: 4120
  misc_feature: Useful for making plants with altered carbohydrate content

SEQ ID NO: 50989 - protein, 380 aa, Arabidopsis thaliana
  misc_feature: Useful for making plants with altered cell wall content and/or composition
MLVPPEYTYLVGPISFSGPYCQANIVFQLDGTIIAPTDSKTWGKGLMWWIDFTKLKGIKVQGKGVIDGRGSGWWQQDSPFIDSDTKLIVPLNNSANQNPPMPIRSELDERMPSIKPTALRFSGSFGVEVTGITIQNSPQCHLKFDDCVGVVVHDIAVSSPGDSPNTDGIHLQNTKDVLIHSTTLACGDDCISIQTGCSNVFVHNVNCGPGHGISIGSLGKEGTKACVSNITVRDVAMHNTMTGVRIKTWQGGVGSVKGIIFSNIQLNQVQIPITINQFYCDHSKCKNQTSAVAVEGVTYERIKGTYTVKPVHFACSDNFPCVDVQLSSIELKPVQEKYRMYDAYCWQTFGELNTPTLPPIDCLKIGKPPRNKVQSDHDVC

SEQ ID NO: 50990 - protein, 364 aa, Arabidopsis thaliana; identical to SEQ ID NO: 9747
  misc_feature: Useful for making plants with modulated biomass
  misc_feature: Useful for making plants with modulated flowering time

SEQ ID NO: 50991 - protein, 279 aa, Panicum virgatum; identical to SEQ ID NO: 444
  misc_feature: Useful for making plants with altered carbohydrate content

SEQ ID NO: 50992 - protein, 277 aa, Arabidopsis thaliana
  misc_feature: Useful for making plants with altered cell wall content and/or composition
MKSFTFLILFLFAAQSISVYAGSFHKDVKIHWGDGRGKIHDNQGKLLSLSLDKSSGSGFQSNQEFLYGKAEVQMKLVPGNSAGTVTTFYLKSPGTTWDEIDFEFLGNISGHPYTLHTNVYTKGSGDKEQQFHLWFDPTANFHTYCITWNPQRIIFTVDGIPIREFMNAESRGVPFPTKQPMRLYASLWEAEHWATRGGLEKTDWSKAPFTAYYRNYNVEGCVWVNGKSVCPANSQWFTQKLDSNGQTRMKGVQSKYMVYNYCSDKKRFPRGVPPECS

SEQ ID NO: 50993 - protein, 246 aa, Arabidopsis thaliana; identical to SEQ ID NO: 9212
  misc_feature: Useful for making plants with altered lignin content
  misc_feature (98)..(98): Xaa is any aa, unknown, or other

SEQ ID NO: 50994 - protein, 312 aa, Arabidopsis thaliana; identical to SEQ ID NO: 9547
  misc_feature: Useful for making plants with altered terpenoid content

SEQ ID NO: 50995 - protein, 329 aa, Arabidopsis thaliana
  misc_feature: Useful for making plants with altered cell wall content and/or composition
MSLLPHLILYLTLLTVVVTGETLRPRFYSETCPEAESIVRREMKKAMIKEARSVASVMRFQFHDCFVNGCDASLLLDDTPNMLGEKLSLSNIDSLRSFEVVDDIKEALEKACPATVSCADIVIMAARDAVALTGGPDWEVKLGRKDSLTASQQDSDDIMPSPRANATFLIDLFERFNLSVKDMVALSGSHSIGQGRCFSIMFRLYNQSGSGKPDPALEPSYRKKLDKLCPLGGDENVTGDLDATPQVFDNQYFKDLVSGRGFLNSDQTLYTNLVTREYVKMFSEDQDEFFRAFAEGMVKLGDLQSGRPGEIRFNCRVVNRRPIDVLLVS

SEQ ID NO: 50996 - protein, 240 aa, Panicum virgatum
  misc_feature: Useful for making plants with altered carbohydrate content
MAALRRAAAVACVLALALGAAAQLTPTFYDGSCPRLQSIVRAGMAAAVQQEPRMGASILRLFFHDCFVQGCDASVLLDDSATLTGEKNAGPNANSLRGYEVIDAIKSQVEAACPDVVSCADILALAARDGVNLLSGPTWAVPLGRRDTRTASQAAANSNLPSPSSSAAALVSAFASKAWTRATWWRSRARTPWGRRGARASGRACTTTPTSAPGSRRSDGRSARRKAAAPPTATWRRWTR

SEQ ID NO: 50997 - protein, 211 aa, Brassica napus
  misc_feature: Useful for making plants with modulated biomass
  misc_feature: Useful for making plants with modulated flowering time
MNTTSSKSKKKQEEGSARFLGVRRRPWGRYAAEIRDPTTKERHWLGTFDTAEEAALAYDRAARSMRGTRARTNFVYSDMPPSSSVTSIISPDDPPPPPPPTAAAPPCSNDPVDYMVMFNQYSSTDSLMLQPHSDQVESSYMFGGSSSCYSNSSSELPPLPSDLSNSSYSQPQWSVDDYSTATYFEGDYVHGPMFSTMPPVSDSFSHFGSYN

SEQ ID NO: 50998 - protein, 358 aa, Arabidopsis thaliana; identical to SEQ ID NO: 9580
  misc_feature: Useful for making plants with altered terpenoid content

SEQ ID NO: 50999 - protein, 318 aa, Oryza sativa subsp. japonica
  misc_feature: Useful for biocontainment applications
MNTRGSGSSSSSSSSQASLMAFSEPPKPASQPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPQYAAAAAAPSSVQYGGGVGAAPHIGSYGHHHHHHHHHGHGAASGASSVGECSTMPVMVPVDPHRSSMSSSLLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDSYSPFSFLSH

SEQ ID NO: 51000 - protein, 241 aa, Arabidopsis thaliana
  misc_feature: Useful for making plants with altered cell wall content and/or composition
  misc_feature: Useful for making plants with altered lignin content
  misc_feature: Useful for making plants with altered terpenoid content
  misc_feature: Useful for making plants with altered tocopherol content
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKSSPPEEEKAARVKVEEEESNTSETTEAEVEPVVPLTPSSWMGFWDVGAGDGIFSIPPLSPTSPNFSVISVT

SEQ ID NO: 51001 - protein, 253 aa, Arabidopsis thaliana
  misc_feature: Useful for making plants with modulated oxidative stress sensitivity
MATPNEVSALFLIKKYLLDELSPLPTTATTNRWMNDFTSFHQTGFEFSEFETKPEIIDLVTPKPEISDFEVKSEISIESNDSFTFQSNPPRVTVQSNRKPPLKIAPPNRTKWIQFATGNPKPELPEPVVAAEEKRHYRGVRMRPWGKFAAEIRDPTRRGTRVWLGTFETAIEAARAYDKEAFRLRGSKAILNFPLEVDKWNPRAEDGRGLYKRKRDSEEEEVKVVKKVLKKEESYAVSDGENVESGLTAIDDW

SEQ ID NO: 51002 - protein, 162 aa, Arabidopsis thaliana; identical to SEQ ID NO: 9462
  misc_feature: Useful for making plants with modulated cold sensitivity

SEQ ID NO: 51003 - protein, 402 aa, Arabidopsis thaliana
  misc_feature: Useful for making plants with modulated drought sensitivity
MGCFHSKAAKEFRGHEDPVKLASETAFSVSEVEALFELFKSISSSVVDDGLINKEEFQLALFKSRKRENIFANRIFDMFDVKRKGVIDFGDFVRSLNVFHPNASLEDKIDFTFRLYDMDCTGYIERQEVKQMLIALLCESEMKLADETIEIILDKTFEDADVNQDGKIDKLEWSDFVNKNPSLLKIMTLPYLRDITTTFPSFVFHSEVDEIATMSIILNNIAFPQIFDMFDVKRKGVIDFGDFVRSLNVFHPNASLEDKIDFTFRLYDMDCTGYIERQEVKQMLIALLCESEMKLADETIEIILDKTFEDADVNQDGKIDKLEWSDFVNKNPSLLKIMTLPYLRDITTTFPSFVFHSEVDEIATMGCFHSKAAKEFRGHEDPVKLASETACKFTRAISLNLL

SEQ ID NO: 51004 - protein, 213 aa, Arabidopsis thaliana
  misc_feature: Useful for making plants with modulated water use efficiency
MGCFHSKAAKEFRGHEDPVKLASETAFSVSEVEALFELFKSISSSVVDDGLINKEEFQLALFKSRKRENIFANRIFDMFDVKRKGVIDFGDFVRSLNVFHPNASLEDKIDFTFRLYDMDCTGYIERQEVKQMLIALLCESEMKLADETIEIILDKTFEDADVNQDGKIDKLEWSDFVNKNPSLLKIMTLPYLRDITTTFPSFVFHSEVDEIAT

SEQ ID NO: 51005 - protein, 215 aa, Panicum virgatum; identical to SEQ ID NO: 21769
  misc_feature: Useful for making plants with altered carbohydrate content

SEQ ID NO: 51006 - protein, 328 aa, Arabidopsis thaliana
  misc_feature: Useful for making plants with altered cell wall content and/or composition
MGVYLGKYCYIMIIMLVLVLGKEVRSQLLKNGYYSTSCPKAESIVRSTVESHFDSDPTISPGLLRLHFHDCFVQGCDGSVLIKGKSAEQAALPNLGLRGLEVIDDAKARLEAVCPGVVSCADILALAARDSVDLSDGPSWRVPTGRKDGRISLATEASNLPSPLDSVAVQKQKFQDKGLDTHDLVTLLGAHTIGQTDCLFFRYRLYNFTVTGNSDPTISPSFLTQLKTLCPPNGDGSKRVALDIGSPSKFDESFFKNLRDGNAILESDQRLWSDAETNAVVKKYASRLRGLLGFRFDYEFGKAMIKMSSIDVKTDVDGEVRKVCSKVN

SEQ ID NO: 51007 - protein, 398 aa, Panicum virgatum; identical to SEQ ID NO: 6380
  misc_feature: Useful for making plants with altered carbohydrate content

SEQ ID NO: 51008 - protein, 418 aa, Panicum virgatum; identical to SEQ ID NO: 21807
  misc_feature: Useful for making plants with altered carbohydrate content

SEQ ID NO: 51009 - protein, 559 aa, Arabidopsis thaliana; identical to SEQ ID NO: 9594
  misc_feature: Useful for making plants with altered lignin content

SEQ ID NO: 51010 - protein, 379 aa, Arabidopsis thaliana
  misc_feature: Useful for making plants with modulated heat sensitivity
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 51011 - protein, 407 aa, Panicum virgatum
  misc_feature: Useful for making plants with altered carbohydrate content
MIPLNRRASLPRAGMEYFDARRKPHNVGKIIAALILTALCIFVLKQSPSFGGNSVFSRHEPGVTHVLVTGGAGYIGSHASLRLLKDNYRVTIVDNLSRGNMGAVKALQKLFPQPGRLQFIFADLGDQKSVNKIFAENAFDAVMHFAAVAYVGESTLEPLRYYHNITSNTLLILEAMASHGVKTLIYSSTCATYGEPEKMPITEATPQFPINPYGKAKKMAEDIILDFSKSKGADMAVMILRYFNVIGSDPEGRLGEAPRPELREHGRISGACFDAALGVIPGLKVKGTDYPTADGTCIRDYIDVTDLVDAHVKALNKAEPRKVGIYNVGTGRGRSVREFVDACKKATGVDIKVEYLNRRPGDYAEVYSDPTKINKELNWTAQYTDLKESLSVAWRWQKSHPHGYGTN

SEQ ID NO: 51012 - protein, 488 aa, Panicum virgatum; identical to SEQ ID NO: 5312
  misc_feature: Useful for making plants with modulated flowering time

SEQ ID NO: 51013 - protein, 428 aa, Panicum virgatum; identical to SEQ ID NO: 2478
  misc_feature: Useful for making plants with altered carbohydrate content

SEQ ID NO: 51014 - protein, 348 aa, Arabidopsis thaliana
  misc_feature: Useful for making plants with altered cell wall content and/or composition
MVGNILVTGGAGYIGSHTVLQLLLGGYNTVVIDNLDNSSLVSIQRVKDLAGDHGQNLTVHQVDLRDKPALEKVFSETKFDAVMHFAGLKAVGESVAKPLLYYNNNLIATITLLEVMAAHGCKKLVFSSSATVYGWPKEVPCTEESPLSGMSPYGRTKLFIEDICRDVQRGDPEWRIIMLRYFNPVGAHPSGRIGEDPCGTPNNLMPYVQQVVVGRLPNLKIYGTDYTTKDGTGVRDYIHVVDLADGHICALQKLDDTEIGCEVYNLGTGKGTTVLEMVDAFEKASGMKIPLVKVGRRPGDAETVYASTEKAERELNWKANFGIEEMCRDQWNWASNNPFGYGSSPNST

SEQ ID NO: 51015 - protein, 258 aa, Arabidopsis thaliana; identical to SEQ ID NO: 9282
  misc_feature: Useful for making plants with modulated nitrogen use efficiency

SEQ ID NO: 51016 - protein, 488 aa, Arabidopsis thaliana; identical to SEQ ID NO: 9756
  misc_feature: Useful for biocontainment applications

SEQ ID NO: 51017 - protein, 345 aa, Panicum virgatum; identical to SEQ ID NO: 3360
  misc_feature: Useful for making plants with altered carbohydrate content

SEQ ID NO: 51018 - protein, 292 aa, Arabidopsis thaliana
  misc_feature: Useful for biocontainment applications
MMKVDQDYSCSIPPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAFKKRTTIPTKRRQLWDPNCLFYDDATLLEPLDKRARHNPDFTATPFKQELLSEASHVQDGDFGSMYLQCIDDDQFSQLPQLESPSLPSEITPHSTTFSENSSRKDDMSSEKRITDWRYLDKFVASQFLMSGED

SEQ ID NO: 51019 - protein, 305 aa, Arabidopsis thaliana
  misc_feature: Useful for making plants with altered cell wall content and/or composition
MSSSNGGVPPGFRFHPTDEELLHYYLKKKISYEKFEMEVIKEVDLNKIEPWDLQDRCKIGSTPQNEWYFFSHKDRKYPTGSRTNRATHSGFWKATGRDKCIRNSYKKIGMRKTLVFYKGRAPHGQKTDWIMHEYRIEDTEDDPCEDGWVVCRVFKKKNLFKVGNDVGSNISNNRLEARSFIRRESPYQGISMFELNKPEEISVHQYPQPPMFQPHHKPLSIGYDYSLALLPRESEYQQACQPSGVEVGTCKAVSEWGIVNCNMVSHEDSSRAMRFEDDGNNTSSTVQPPSNLLSLRGENGFLGLF

SEQ ID NO: 51020 - protein, 549 aa, Arabidopsis thaliana; identical to SEQ ID NO: 9542
  misc_feature: Useful for making plants with altered alkaloid content

SEQ ID NO: 51021 - protein, 283 aa, Arabidopsis thaliana
  misc_feature: Useful for making plants with altered lignin content
  misc_feature: Useful for making plants with modulated biomass
MMMGKEDLGLSLSLGFSQNHNPHQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 51022 - protein, 315 aa, Arabidopsis thaliana
  misc_feature: Useful for biocontainment applications
  misc_feature: Useful for making plants with modulated biomass
  misc_feature: Useful for making plants with modulated flowering time
MSERDDGLGLSLSLSLGFNQKDPSSRLNPMPLASYASSSHMQHMQQSNYNHPQKIQNTWINMFQSSERNSDMRSFLRGIDVNRAPSTVVVDVEDEGAGVSSPNSTVSSVMSGKKSERELMAAAGAVGGGRVEDNEIERASCSLGGGSDDEDGSGNGDDSSRKKLRLSKEQALVLEETFKEHSTLNPKQKMALAKQLNLRTRQVEVWFQNRRARTKLKQTEVDCEYLKRCCENLTDENRRLQKEVSELRALKLSPHLYMHMKPPTTLTMCPSCERVAVTSSSSSVAPPVMNSSSPMGPMSPWAAMPLRQRPAAGSH

SEQ ID NO: 51023 - protein, 282 aa, Arabidopsis thaliana
  misc_feature: Useful for making plants with altered alkaloid content
MMMGKEDLGLSLSLGFAQNHPLQLNLKPTSSPMSNLQMFPWNQTLVSSSDQQKQQFLRKIDVNSLPTTVDLEEEIGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 51024 - protein, 473 aa, Arabidopsis thaliana
  misc_feature: Useful for making plants with modulated cold sensitivity
MIKLWMMTSLQLAELFVSSIVHLLYGFYIFSSAVAGDISQTLNDYLFKSNVAFGETGQNQTNVEGLPPIVLVHGIFGFGKGRLGGLSYFGGAEKKDERVLVPEGGSLTSIYDRARELFYYLKGGVVDFGEEHSEACGHSRFGRRYEQGQYPEWDEDHPIHFVGHSAGAQVVRVLQQMLADQAFEGFEETNENWVLSVTSLSGAFNGTTRTYLDGMRTDDGVSMKPICLLQLCRIGVIMYDWLDISWLKTYYNFGFDHFNISWKKTGVRGLVDCLMGNTGPFASGDWILPDLTIQGSTSINSNLQTFPNTYYFSYATKRTRRVMGMTIPSGVLGIHPMLFLRVFQMSQWKFPQDVSPPYKGYRDEDWQENDGALNTISMTHPRLPVEHPSRFIRSDSECQTLQPGIWYYKIVEADHIMFIVNRERAGVQFDLIYDSIFQRCRKHVFRKIPQTLPNQSPSSPRSSSSPRINNFVH

SEQ ID NO: 51025 - protein, 290 aa, Arabidopsis thaliana
  misc_feature: Useful for making plants with altered cell wall content and/or composition
MVGMDLFKCVMMIMVLVVSCGEAVSGAKFDELYRSSWAMDHCVNEGEVTKLKLDNYSGAGFESRSKYLFGKVSIQIKLVEGDSAGTVTAFYMSSDGPNHNEFDFEFLGNTTGEPYIVQTNIYVNGVGNREQRLNLWFDPTTEFHTYSILWSKRSVVFMVDETPIRVQKNLEEKGIPFAKDQAMGVYSSIWNADDWATQGGLVKTDWSHAPFVASYKEFQIDACEIPTTTDLSKCNGDQKFWWDEPTVSELSLHQNHQLIWVRANHMIYDYCFDATRFPVTPLECQHHRHL

SEQ ID NO: 51026 - protein, 228 aa, Oryza sativa subsp. japonica
  misc_feature: Useful for making plants with modulated water use efficiency
MDAASFSDYSSGTPSPVGGVSGGVDGDDGGSSSSYMTVSSAPPKRRAGRTKFKETRHPVYKGVRRRNPGRWVCEVREPHGKQRIWLGTFETAEMAARAHDVAALALRGRAACLNFADSPRLLRVPPMGSGHDEIRRAAAVAADQFRPAPDRQGNVATAEEAADTTPLDATTQSVVDDPYCIIDDRLDFGMQGYLDMAQGMLIDPPPMAGSSTSGGDDDDDGEVKLWSY

SEQ ID NO: 51027 - protein, 236 aa, Panicum virgatum
  misc_feature: Useful for making plants with altered carbohydrate content
ARWRFVNADECLMTRMQEMSLDYHFTVEQEVSSSVCAFFGFNGTAGVWRISAINEAGGWKDRTTVEDMDLAIRASLKGWKFVYLGDVQVKSELPSTFKAFRFQQHRWSCGPANLFRKMLMEIVTNKKVTIWKKIHVIYNFFLIRKIVAHIITFSFYCLVIPATIFVPEVRIPKWGCVYIPSAITLLNSVGTPRSFHLLFFWVAFENVMSLHRTKATLIGLLEAGRANEWVVTAKLG

SEQ ID NO: 51028 - protein, 534 aa, Arabidopsis thaliana
  misc_feature: Useful for making plants with altered cell wall content and/or composition
MDGVSPKFVLPETFDGVRMEITGQLGMIWELVKAPVIVPLLQLAVYICLLMSVMLLCERVYMGIVIVLVKLFWKKPDKRYKFEPIHDDEELGSSNFPVVLVQIPMFNEREVYKLSIGAACGLSWPSDRLVIQVLDDSTDPTVKQMVEVECQRWASKGINIRYQIRENRVGYKAGALKEGLKRSYVKHCEYVVIFDADFQPEPDFLRRSIPFLMHNPNIALVQARWRFVNSDECLLTRMQEMSLDYHFTVEQEVGSSTHAFFGFNGTAGIWRIAAINEAGGWKDRTTVEDMDLAVRASLRGWKFLYLGDLQVKSELPSTFRAFRFQQHRWSCGPANLFRKMVMEIVRNKKVRFWKKVYVIYSFFFVRKIIAHWVTFCFYCVVLPLTILVPEVKVPIWGSVYIPSIITILNSVGTPRSIHLLFYWILFENVMSLHRTKATLIGLFEAGRANEWVVTAKLGSGQSAKGNTKGIKRFPRIFKLPDRLNTLELGFAAFLFVCGCYDFVHGKNNYFIYLFLQTMSFFISGLGWIGTYVPS

SEQ ID NO: 51029 - protein, 141 aa, Zea mays; identical to SEQ ID NO: 9380
  misc_feature: Useful for making plants with modulated nitrogen use efficiency

SEQ ID NO: 51030 - protein, 281 aa, Arabidopsis thaliana; identical to SEQ ID NO: 9510
  misc_feature: Useful for making plants with altered alkaloid content
  misc_feature (67)..(67): Xaa is any aa, unknown, or other

SEQ ID NO: 51031 - protein, 830 aa, Arabidopsis thaliana
  misc_feature: Useful for making plants with altered cell wall content and/or composition
MSSWASFIFLFIFSFLTSFRVFAQDPTYRYHSCPNTTIFSRDSAYFSNLQTLLSFLSSPDASSSYSSGFRNDAVGTFPDRVTGLFDCRGDLPPEVCHNCVAFAVKDTLIRCPNERDVTLFYDECTLRYSNLVVTSALDPTYVYHVCPSWATFPRSSTYMTNLITLLSTLSSPSASYSTGFQNATAGKHPDRVTGLFNCRGDVSPEVCRRCVSFAVNETSTRCPIEKEVTLYYDQCTLRYSNRNILSTSNTNGGIILANSQNMTSNEQARFKDLVLTTMNQATIAAANSSKRFDARSANFTTLHSLYTLVQCTHDLTRQDCLSCLQQIINQLPTEKIGGQFIVPSCSSRFELCLFYNQSAVTTPQPQQNSAPPPPPTSIPSPRPGLNSRFPLITCLSAVSFEKFKDLLKPGFICILIKIVSENTGKGGNSSVIIIAVVVSITALLLLFVAVFSVRTKRRKKMIGAIPLLNVKRKDTEVTEPLAENGDSITTAGSLQFDFKAIVAATNNFLPINKLGQGGFGEVYKGTFPSGVQVAVKRLSKTSGQGEREFENEVVVVAKLQHRNLVRLLGYCLEGEEKILVYEFVHNKSLDYFLFDTTMKRQLDWTRRYKIIGGIARGILYLHQDSRLTIIHRDLKAGNILLDADMNPKVADFGMARIFGMDQTEANTRRVVGTYGYMAPEYAMYGQFSMKSDVYSFGVLVFEIISGMKNSSLYQMDDSVSNLVTYTWRLWSNGSQLDLVDPSFGDNYQTHDITRCIHIALLCVQEDVDDRPNMSAIVQMLTTSSIVLAVPKQPGFFFRGRHEQVGEVGSSVDRLALCSIDDASITSVAPR

SEQ ID NO: 51032 - protein, 334 aa, Panicum virgatum
  misc_feature: Useful for making plants with altered carbohydrate content
  misc_feature (192)..(192): Xaa is any aa, unknown, or other
MATSMGCLVLLCLVSPLFLASAVHGHPWGGLFPQFYDHSCPKAKEIVQSIVAQAVAKETRMAASLVRLHFHDCFVKGCDASVLLDNSSSIVSEKGSNPNRNSLRGFEVVDQIKAALEAACPGTVSCADILALAARDSTVLVGGPYWDVPLGRRDSLGASIQGSNNDIPAPNNTLPTIITKFKRQGLNVVDVXALSGGHTIGMSRCTSFRQRLYNQTGNGMADSTLDVSYVAQLRQGCPRSGGDNNLFPLDFVTPAKFDNFYYKNLLAGKGLLSSDEVLLTKSAETATLVKAYAADVNLFFQHFAQSMVNMGNISPLTGSQGEIRKNCRRLNNDH

SEQ ID NO: 51033 - protein, 336 aa, Arabidopsis thaliana
  misc_feature: Useful for making plants with altered cell wall content and/or composition
MAKSLNILIAALSLIAFSPFCLCSKAYGSGGYLFPQFYDQSCPKAQEIVQSIVAKAFEHDPRMPASLLRLHFHDCFVKGCDASILLDSSGTIISEKRSNPNRNSARGFELIEEIKHALEQECPETVSCADILALAARDSTVITGGPSWEVPLGRRDARGASLSGSNNDIPAPNNTFQTILTKFKRQGLDLVDLVSLSGSHTIGNSRCTSFRQRLYNQSGNGKPDMTLSQYYATLLRQRCPRSGGDQTLFFLDFATPFKFDNHYFKNLIMYKGLLSSDEILFTKNKQSKELVELYAENQEAFFEQFAKSMVKMGNISPLTGAKGEIRRICRRVNHAY

SEQ ID NO: 51034 - protein, 340 aa, Zea mays
  misc_feature: Useful for making plants with modulated nitrogen use efficiency
MVSSSSSPSATAAAAAAVVLAVALMTTTCFHGATAQLCEDYYDSTCPDAYDIVNQVLVDAVQSDTRIFASLIRLHFHDCFVQGCDASLLLDSVPGMPSEKTSAPNNGSARGFGVVDAAKAALESACPGVVSCADILAIAAEISVELSGGPSWGVLLGRLDSKTSDFNGSLDLPEPTDNLTILQQKFSNLSLNDVDLVALSGGHTFGRVQCKFITDRLYNFSGTNMPDPTLDASYRAFLTQRCPRNGDPTALNDLDPTTPDTFDNNYYTNIEVNRGILNSDQELKSSPLAQGTTAPIVDQFAASQDDFFASFAQSMINMGNIKPLTDPSRGEVRTNCRRVN

SEQ ID NO: 51035 - protein, 83 aa, Arabidopsis thaliana
  misc_feature: Useful for making plants with altered cell wall content and/or composition
  misc_feature: Useful for making plants with modulated light quality response
KTPAYFDNHYFINLLEGRGLLISDNVLVSEDHEGEIFQKVWEYAVNQDLFFIDFVESMLKMGNINVLTGIEGEIRENCRFVNI

SEQ ID NO: 51036 - protein, 216 aa, Arabidopsis thaliana
  misc_feature: Useful for making plants with modulated salt sensitivity
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 51037 - protein, 216 aa, Arabidopsis thaliana; identical to SEQ ID NO: 51036
  misc_feature: Useful for making plants with modulated nitrogen use efficiency

SEQ ID NO: 51038 - protein, 216 aa, Arabidopsis thaliana; identical to SEQ ID NO: 9353
  misc_feature: Useful for making plants with modulated low light sensitivity

SEQ ID NO: 51039 - protein, 181 aa, Arabidopsis thaliana
  misc_feature: Useful for making plants with modulated biomass
  misc_feature: Useful for making plants with modulated flowering time
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 51040 - protein, 251 aa, Arabidopsis thaliana; identical to SEQ ID NO: 9754
  misc_feature: Useful for making plants with modulated biomass
  misc_feature: Useful for making plants with modulated flowering time

SEQ ID NO: 51041 - protein, 394 aa, Panicum virgatum; identical to SEQ ID NO: 6400
  misc_feature: Useful for making plants with altered carbohydrate content

SEQ ID NO: 51042 - protein, 379 aa, Arabidopsis thaliana; identical to SEQ ID NO: 9297
  misc_feature: Useful for making plants with altered lignin content

SEQ ID NO: 51043 - protein, 343 aa, Panicum virgatum; identical to SEQ ID NO: 5206
  misc_feature: Useful for making plants with altered carbohydrate content

SEQ ID NO: 51044 - protein, 329 aa, Arabidopsis thaliana
  misc_feature: Useful for making plants with altered cell wall content and/or composition
MAALKMTISCFLFLQVIYCLLSSFAPTNVQGLKVGFYDKACPKAELIVKKSVFEAVKNDRTIAAPLLRMFFHDCFVRGCEGSVLLELKNKKDEKNSIPNLTLRGFEIIDNVKAALEKECPGIVSCSDVLALVARDAMVALNGPSWEVETGRRDGLVTNITEALLNLPSPFNNISSLITQFQSKGLDKKDLVVLSGGHTIGNGHCPQITNRLYNFTGKGDSDPNLDTEYAVKLRGKCKPTDTTTALEMDPGSFKTFDESYFKLVSQRRGLFQSDAALLDNQETKSYVLKSLNSDGSTFFKDFGVSMVKMGRIGVLTGQVGEVRKKCRMVN

SEQ ID NO: 51045 - protein, 294 aa, Arabidopsis thaliana
  misc_feature: Useful for making plants with modulated light quality sensitivity
MASSSRLCDSCKSTAATLFCRADAAFLCGNCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYCGFGVVPSF

SEQ ID NO: 51046 - protein, 373 aa, Arabidopsis thaliana
  misc_feature: Useful for making plants with modulated flowering time
MLKQESNDIGSGENNRARPCDTCRSNACTVYCHADSAYLCMSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 51047 - protein, 300 aa, Arabidopsis thaliana
  misc_feature: Useful for making plants with modulated heat sensitivity
  misc_feature (288)..(288): Xaa is any aa, unknown, or other
  misc_feature (289)..(289): Xaa is any aa, unknown, or other
MVLLLRYRSLTINLTPLIPKSQKFHTLQSFRNPNFISIPKISASTNNPTTTTNRSISDATKFAKSVLFIPPGVEIEELTDDMVLPGSNIVIGPFAGHSQIKEVEFVKSSARARDCPKDDRPEIAILGRSNVGKSSLINCLVRKKEVALTSKKPGKTQLINHFLVNKSWYIVDLPGYGFAKVSDAAKTDWSAFTKGYFLNRDSLVCVLLLIDASVPPQKIDLDCANWLGRNNVPMTFVFTKCDKMKATKGKRPDENIKAFQQIIRENFKVHPPWILTSSVSGLGRDELXXHMSQLRNYWDQ

SEQ ID NO: 51048 - protein, 314 aa, Arabidopsis thaliana
  misc_feature: Useful for making plants with modulated biomass
MMEIRTPKTGKAKRVLESRAPKLVETGKKTLILHGTKTSATLSSVMTELYRLKKGGAIRYSRRNENIRPFESGGETSLEFFSQKTDCSIFVYGSHTKKRPDNLVLGRMYDHQVYDLIEVGIENFKSLRAFSYYKKFAPHEGTKPFICFIGEGFENVSELKHLKEVLTDLFRGEVVDNLNLTGLDRAYVCSAISPTKVFLTHCALKLKKSGSIVPRMELVEVSPSMDLVIRRNRLPNDSLMKEAMRTSKDKPKKKEKNVDQDAVLGKTGKIYMPDQKLKEMKLFDKSKGSKRERKDAKLKHKEETVAKKMKVSSE

SEQ ID NO: 51049 - protein, 159 aa, Arabidopsis thaliana
  misc_feature: Useful for making plants with modulated nitrogen use efficiency
MHRLLLESHGGGNETSGSGGGDGYTRDMNFDANMVIILAALLCALILALGLNSILRCAMRCGFGLSSSAAAGTVADRAGLKKRELKKFPVAEYGSGEVKIAATECAICLGEFADGERVRVLPPCNHSFHMSCIDTWLVSHSSCPNCRHSLIEVHVAGSE

SEQ ID NO: 51050 - protein, 324 aa, Arabidopsis thaliana; identical to SEQ ID NO: 9354
  misc_feature: Useful for making plants with altered lignin content

SEQ ID NO: 51051 - protein, 147 aa, Arabidopsis thaliana
  misc_feature: Useful for making plants with altered alkaloid content
  misc_feature (94)..(94): Xaa is any aa, unknown, or other
MEEKPKKAIPVTETAVKAKHYRGVRQRPWGKFAAEIRDPAKNGARVWLGTFETAEDAALAYDIAAFRMRGSRALLNFPLRVNSGEPDPVRITSXRSSSSSSSSSSSTSSSENGKLKRRRKAENLTSEVVQVKCEVGDETRVDELLVS

SEQ ID NO: 51052 - protein, 338 aa, Arabidopsis thaliana
  misc_feature: Useful for making plants with altered lignin content
MVEEGGVVVNQGGDQEVVDLPPGFRFHPTDEEIITHYLKEKVFNIRFTAAAIGQADLNKNEPWDLPKIAKMGEKEFYFFCQRDRKYPTGMRTNRATVSGYWKATGKDKEIFRGKGCLVGMKKTLVFYTGRAPKGEKTNWVMHEYRLDGKYSYHNLPKTARDEWVVCRVFHKNAPSTTITTTKQLSRIDSLDNIDHLLDFSSLPPLIDPGFLGQPGPSFSGARQQHDLKPVLHHPTTAPVDNTYLPTQALNFPYHSVHNSGSDFGYGAGSGNNNKGMIKLEHSLVSVSQETGLSSDVNTTATPEISSYPMMMNPAMMDGSKSACDGLDDLIFWEDLYTS

SEQ ID NO: 51053 - protein, 626 aa, Arabidopsis thaliana; identical to SEQ ID NO: 9753
  misc_feature: Useful for making plants with modulated biomass

SEQ ID NO: 51054 - protein, 348 aa, Panicum virgatum; identical to SEQ ID NO: 5232
  misc_feature: Useful for making plants with altered carbohydrate content

SEQ ID NO: 51055 - protein, 345 aa, Panicum virgatum
  misc_feature: Useful for making plants with altered carbohydrate content
FPLHSISWSSFPSSTRGGGGGGELRKGALLAGAGSMAGALLFILLLFCPFAEETAAAADKRVVHDDLNPITTVPSTNPTPTIITVPSTNPTITIPSLNPLPTPITDTPPSTAPPAPIIYPLPTPSTSSPPTVPVTNPAVTTPSTFPPSAPFTNPPASNPTPTPPPAQIITAPAVSSQQVWCVVKAAGSSEAALQNALDYACGIGGADCSAIQPSGSCYYPNTLQAHASYAFNTYYQRNPAPSSCDFGGTAMLVTANPSSGSCVFASSSSSTVGYNPASTATPLASSSGSDSGSPVLNASGAGSSEPSEFSPDIPGAVDMDNAWRSINPPQWAWAAMVWILHFVCI

SEQ ID NO: 51056 - protein, 194 aa, Arabidopsis thaliana
  misc_feature: Useful for making plants with altered cell wall content and/or composition
MAPLVLYLLTLLMAGHTSASWCVCKTGLSDSVLQKTLDYACGNGADCNPTHPKGSCFNPDNVRAHCNYAVNSFFQKKGQASESCNFTGTATLTTTDPSYTGCAFPSSASGSSGSGSTTVTPGKNSPKGSNSITTFPGGNSPYSGTPSTGLLGGNITDATGTGLNPDYSTESSGFALYYSNNLLLTGFCSLVMML

SEQ ID NO: 51057 - protein, 270 aa, Oryza sativa
  misc_feature: Useful for biocontainment applications
MGRGRIEIKRIENTTSRQVTFCKRRNGLLKKAYELSVLCDAEVALIVFSSRGRLYEYSNNNNVKATIDRYKKAHACGSTSGAPLIEVNAQQYYQQESAKLRHQIQMLQNTNKHLVGDNVSNLSLKELKQLESRLEKGISKIRARKNELLASEINYMAKREIELQNDNMDLRTKIAEEEQQLQQVTVARSAAMELQAAAAAQQQQQNPFAVAAAQLDMKCFFPLNLFEAAAQVQAVAAQRQQIIPTELNLGYHHHLAIPGAAAADAPPPHF

SEQ ID NO: 51058 - protein, 256 aa, Arabidopsis thaliana
  misc_feature: Useful for biocontainment applications
  misc_feature: Useful for making plants with altered alkaloid content
  misc_feature: Useful for making plants with altered lignin content
  misc_feature: Useful for making plants with modulated biomass
  misc_feature: Useful for making plants with modulated flowering time
MLFPHERKKEKERSQGFYLVTRLRIRMGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 51059 - protein, 197 aa, Zea mays
  misc_feature: Useful for making plants with modulated nitrogen use efficiency
MGRGRSEIKRIENPTQRQSTFYKRRDGLFKKARELSVLCDVDLLLLLFSTSGKLYHYLSPTVPSVKDLVERYEATTHTKVWTDIRQERRAELEKAEQMCELMEKELRVMTVDDGEQYTVPSLELLEHSLEAAVRKVRSEKDRKIGGEINYLENIIRGRHEERYGLCNKLAHSQASNNEGGGGSTPPSSGLELKLGLN

SEQ ID NO: 51060 - protein, 267 aa, Panicum virgatum; identical to SEQ ID NO: 488
  misc_feature: Useful for making plants with altered carbohydrate content

SEQ ID NO: 51061 - protein, 375 aa, Zea mays
  misc_feature: Useful for making plants with modulated water use efficiency
MVQQAAKEVIPLLTPYKMGQFELSHRVVLAPLTRCRSYGNVPQPHAAVYYSQRATRGGLLIAEATGVSATAQGYPETPGIWTQEQVEAWKPIVDAVHRKGAIFVCQIWHVGRVSTNELQPNGDAPISSTDKQISPDAESGTAYSKPRRLRTDEVPGIVDDFRRAARNAIQAGFDAVEIHGAHGYLLEQFMKDSCNDRTDQYGGSLENRCRLAVEVVDAVVREVGARRVGIRLSPFVDFVDCVDSDPVALGHYMVQQLNRHSGLLYCHMVEPRMATVDGRRQIPHGLLPFRKAFHGTFIAAGGYDREDGNKVVAEGYADLVAYGRLFLANPDLPRRFELDVALNKYDRSTFYTQDPIVGYTDYPFFEEDGKNEESV

SEQ ID NO: 51062 - protein, 121 aa, Arabidopsis thaliana
  misc_feature: Useful for making plants with modulated light quality sensitivity
EKIEVIDFSSYIDVSTDPGHYAIFWEISGETNEDVLQDCCNCLDRAFIDAGYVSSRKCKTIGALELRVVAKGTFRKIQEHFLGLGSSAGQFKMPRCVKPSNAKVLQILCENVVSSYFSTAF

SEQ ID NO: 51063 - protein, 209 aa, Brassica napus; identical to SEQ ID NO: 9710
  misc_feature: Useful for making plants with modulated salt sensitivity
  misc_feature (156)..(156): Xaa is any aa, unknown, or other
  misc_feature (158)..(158): Xaa is any aa, unknown, or other
  misc_feature (168)..(168): Xaa is any aa, unknown, or other
  misc_feature (183)..(183): Xaa is any aa, unknown, or other
  misc_feature (187)..(187): Xaa is any aa, unknown, or other
  misc_feature (196)..(196): Xaa is any aa, unknown, or other
  misc_feature (197)..(197): Xaa is any aa, unknown, or other

SEQ ID NO: 51064 - protein, 267 aa, Arabidopsis thaliana; identical to SEQ ID NO: 9449
  misc_feature: Useful for biocontainment applications
  misc_feature: Useful for making plants with altered terpenoid content
  misc_feature: Useful for making plants with modulated biomass
  misc_feature: Useful for making plants with modulated flowering time

SEQ ID NO: 51065 - protein, 315 aa, Zea mays; identical to SEQ ID NO: 9492
  misc_feature: Useful for making plants with altered terpenoid content
  misc_feature (109)..(109): Xaa is any aa, unknown, or other

SEQ ID NO: 51066 - protein, 291 aa, Arabidopsis thaliana; identical to SEQ ID NO: 9197
  misc_feature: Useful for making plants with altered lignin content

SEQ ID NO: 51067 - protein, 139 aa, Arabidopsis thaliana; identical to SEQ ID NO: 9305
  misc_feature: Useful for making plants with modulated biomass

SEQ ID NO: 51068 - protein, 209 aa, Arabidopsis thaliana
  misc_feature: Useful for making plants with modulated biomass
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 51069 - protein, 356 aa, Arabidopsis thaliana
  misc_feature: Useful for making plants with modulated nitrogen use efficiency
MNVKPMEQIMIPNNNTHQPNTTSNARPNTILTSNGVSTAGATVSGVSNNNNNTAVVAERKARPQEKLNCPRCNSTNTKFCYYNNYSLTQPRYFCKGCRRYWTEGGSLRNVPVGGSSRKNKRSSSSSSSNILQTIPSSLPDLNPPILFSNQIHNKSKGSSQDLNLLSFPVMQDQHHHHVHMSQFLQMPKMEGNGNITHQQQPSSSSSVYGSSSSPVSALELLRTGVNVSSRSGINSSFMPSGSMMDSNTVLYTSSGFPTMVDYKPSNLSFSTDHQGLGHNSNNRSEALHSDHHQQGRVLFPFGDQMKELSSSITQEVDHDDNQQQKSHGNNNNNNNSSPNNGYWSGMFSTTGGGSSW

SEQ ID NO: 51070 - protein, 271 aa, Panicum virgatum; identical to SEQ ID NO: 7770
  misc_feature: Useful for making plants with altered carbohydrate content

SEQ ID NO: 51071 - protein, 269 aa, Arabidopsis thaliana; identical to SEQ ID NO: 9219
  misc_feature: Useful for making plants with altered alkaloid content

SEQ ID NO: 51072 - protein, 250 aa, Panicum virgatum
  misc_feature: Useful for making plants with altered carbohydrate content
MAGRRIAVAAAFLALAAVVPAALAQAPGPAAAPSGPPNVTAILEKGGQYTTFIRLMKETQQDTQLNSQLNSSFGNNGGGGYTVFAPTDNAFNNLKPGTLNSLTQQQQVSLVQGHVLPNFYSMDSFQTASNPVRTQASGRDGPYTLNITSDTNNQVNVSSGVVDVRINNALYNAKPLAVYSVDKVLLPMELFGAKAPAAAPTASEGKPRKGGSSDASSPAGSEDAEPTGAASARAVGWSVAGLAAVLGYLL

SEQ ID NO: 51073 - protein, 286 aa, Arabidopsis thaliana
  misc_feature: Useful for making plants with modulated biomass
MNFKNVKVPKGPGGGVIAAVVIGGLSLYGATHTLYNVDGGHRAIVFNRLVGIKDKVYPEGTHLMIPWFERPIIYDVRAKPYLVESTSGSRDLQMVKIGLRVLTRPMADQLPEVYRSLGENYRERVLPSIIHETLKAVVAQYNASQLITQRESVSREIRKILTLRAANFHIALDDVSITGLTFGKEFTAAIEGKQVAAQEAERAKFIVEKAEQDKRSAVIRAEGEAKSAQLIGQAIANNQAFLTLRKIEAAREIAQTISRSANKVYLSSNDLLLNLQAMDLDVKPKK

SEQ ID NO: 51074 - protein, 309 aa, Arabidopsis thaliana
  misc_feature: Useful for making plants with altered cell wall content and/or composition
MKVVAICALQNLVMYSRSNKRAVAEAGGVQVVLDLISSSDPETSVQAAMFVKLLFSNHTVQEYASSETVRAITAAIEKDLWATGTVNDEYLKALNSLFNNFPRLRATEPATLSIPHLVTSLKTGSEATQEAALDALFLLRQAWSACPAEVSRAQSVAAADAIPLLQYLIQSGPPRFQEKAEFLLQCLPGTLVVTIKRGNNMKQSVGNPSVFCKITLGNNPPRQTKVISTGPNPEWDESFSWSFESPPKGQKLHISCKNKSKMGKSSFGKVTIQIDRVVMLGAVAGEYSLLPESKSGPRNLEIEFQWSNK

SEQ ID NO: 51075 - protein, 349 aa, Glycine max
  misc_feature: Useful for making plants with modulated oxidative stress sensitivity
MAEKLVLVSDMASTMKQVPSNFIRPLGDRPNLQGVVQSSDVCIPLIDLQDLHGPNRSHIIQQIDQACQNYGFFQVTNHGVPEGVIEKIMKVTREFFGLPESEKLKSYSTDPFKASRLSTSFNVNSEKVSSWRDFLRLHCHPIEDYIKEWPSNPPSLREDVAEYCRKMRGVSLKLVEAISESLGLERDYINRVVGGKKGQEQQHLAMNYYPACPEPELTYGLPGHTDPTVITILLQDEVPGLQVLKDGKWVAVNPIPNTFVVNVGDQIQVISNDKYKSVLHRAVVNCNKDRISIPTFYFPSNDAIIGPAPQLIHHHHHPPQYNNFTYNEYYQNFWNRGLSKETCLDIFKA

SEQ ID NO: 51076 - protein, 431 aa, Arabidopsis thaliana
  misc_feature: Useful for making plants with modulated biomass
MNVVRRLTSIASGRNFVSSDNVGETETPRSKPNQNREETESTETTSYEKDSVSSSENSDHLPKEIREDMDCGIIKGNGTESGRIITTKKKGLNDQKDKTISYRAEHVIGTGSFGVVFQAKCLETEEKVAIKKVLQDKRYKNRELQIMRMLDHPNVVELKHSFFSTTEKDELYLNLVLEYVPETIYRASRSYTKMNQHMPLIYIQLYTYQICRAMNYLHQVVGVCHRDIKPQNLLVNNVTHEVKICDFGSAKMLIPGEPNISYICSRYYRAPELIFGATEYTSAIDMWSVGCVMAELFLGHPLFPGETSVDQLVEIIKILGTPAREEIKNMNPRYNDFKFPQIKAQPWHKIFRRQVSPEAMDLASRLLQYSPNLRCTALEACAHPFFDDLRDPRASLPNGRALPPLFDFTAQELAGASVELRHRLIPEHARK

SEQ ID NO: 51077 - protein, 224 aa, Arabidopsis thaliana
  misc_feature: Useful for making plants with modulated nitrogen use efficiency
MNQEEHVKLLGLWGSPFSKRVEMVLKLKGIPYEYIEEDVYGNRSPMLLKYNPIHKKVPVLIHNGRSIAESLVIVEYIEDTWKTTHTILPQDPYERAMARFWAKYVDEKVMLAVKKACWGPESEREKEVKEAYEGLKCLEKELGDKLFFGGETIGFVDIAADFIGYWLGIFQEASGVTIMTAEEFPKLQRWSEDFVGNNFIKEVLPPKEKLVAVLKAMFGSVTSN

SEQ ID NO: 51078 - protein, 234 aa, Arabidopsis thaliana
  misc_feature: Useful for making plants with modulated biomass
MGEKQEVKLLGVWYSPYAIRTKIALRLKSVDYDYVEEDLFGSKSELLLKSNPVHKKVPVLLHYNKPIVESLNIVEYIDETWNSSAPSILPSHPYDRALARFWSDFVDNKWFPALRVAAIAKSEDAKAKAMEEVEEGLLQLEDAFVSISKGKPFFGGEVIGFMDICFGSFVVLLKAREKFKAEKLLDESKTPSLCKWADRFLSDETVKNVAPDIEKVAEFLQELEVRAQSAASRS

SEQ ID NO: 51079 - protein, 219 aa, Arabidopsis thaliana
  misc_feature: Useful for making plants with modulated drought sensitivity
MANEVILLDFWPSMFGMRTRIALREKGVEFEYREEDLRNKSPLLLQMNPIHKKIPVLIHNGKPVNESIIQVQYIDEVWSHKNPILPSDPYLRAQARFWADFIDKKLYDAQRKVWATKGEEQEAGKKDFIEILKTLESELGDKPYFSGDDFGYVDIALIGFYTWFPAYEKFANFSIESEVPKLIAWVKKCLQRESVAKSLPDPEKVTEFVSELRKKFVPE

SEQ ID NO: 51080 - protein, 200 aa, Oryza sativa subsp. indica
  misc_feature: Useful for making plants with modulated water use efficiency
MASHQDQASYRAGETKAHTEEKAVQVMGASKDKASEAKDRASEAAVHAAGKGQDTKEATKEKAQAAKERASETAQAAKDKTSGTAQAARDKAAESKDQTGGFLGEKTEQAKQKAAETAGAAKQKTAETAQYTKDSAIAGKDKTGSVLQQASEQVKSTVVGAKDAVMSTLGMTEDKAGTDDGANKDTSATAAATETTARDH

SEQ ID NO: 51081 - protein, 295 aa, Arabidopsis thaliana
  misc_feature: Useful for making plants with modulated biomass
MDSSPVSARFDIFEIYRRFCAIRSGQQLCNKKPCDGEESQRFNLSKEAITQLLYLVENKFQARNSIFDELFKLMSRLDLMVDFTEFTCFYDFVFFMCRENGQKNITISRAITAWKLVLAGRFRLLNRWCDFIEKNQRHNISEDTWQQVLAFSRCVHENLEGYDSEGAWPVLIDDFVEHMYSILGPNKDTSLFCKCGDTESESCLYQEDEHHKDYRRPHTGLRNIPGLKRKTSKKNDEEEEDEDEEVLETQNSSSLLNFKRIKTSNSPRCSSKSPCSIERSLSQGFASLLSTGDKP

SEQ ID NO: 51082 - protein, 259 aa, Glycine max; identical to SEQ ID NO: 9585
  misc_feature: Useful for making plants with altered lignin content
  misc_feature (204)..(204): Xaa is any aa, unknown, or other

SEQ ID NO: 51083 - protein, 298 aa, Arabidopsis thaliana; identical to SEQ ID NO: 9341
  misc_feature: Useful for making plants with modulated biomass

SEQ ID NO: 51084 - protein, 291 aa, Arabidopsis thaliana
  misc_feature: Useful for making plants with altered cell wall content and/or composition
MGRILNRTVLMTLLVVTMAGTAFSGSFNEEFDLTWGEHRGKIFSGGKMLSLSLDRVSGSGFKSKKEYLFGRIDMQLKLVAGNSAGTVTAYYLSSEGPTHDEIDFEFLGNETGKPYVLHTNVFAQGKGNREQQFYLWFDPTKNFHTYSLVWRPQHIIFMVDNVPIRVFNNAEQLGVPFPKNQPMKIYSSLWNADDWATRGGLVKTDWSKAPFTAYYRGFNAAACTVSSGSSFCDPKFKSSFTNGESQVANELNAYGRRRLRWVQKYFMIYDYCSDLKRFPQGFPPECRKSRV

SEQ ID NO: 51085 - protein, 414 aa, Arabidopsis thaliana; identical to SEQ ID NO: 9577
  misc_feature: Useful for making plants with altered alkaloid content
  misc_feature: Useful for making plants with altered lignin content

SEQ ID NO: 51086 - protein, 342 aa, Arabidopsis thaliana; identical to SEQ ID NO: 9592
  misc_feature: Useful for making plants with modulated salt sensitivity

SEQ ID NO: 51087 - protein, 195 aa, Arabidopsis thaliana; identical to SEQ ID NO: 9188
  misc_feature: Useful for making plants with modulated low light sensitivity

SEQ ID NO: 51088 - protein, 280 aa, Arabidopsis thaliana
  misc_feature: Useful for making plants with altered sterol content
MSGSSSPSLWLAPNPSKRWGELFFLFYTPFWLTLCLGIVVPYKLYETFTELEYLLLALVSAVPAFVIPMLLVGKADRSLCWKDRYWVKANLWIIVFSYVGNYFWTHYFFKVLGASYTFPSWKMNNVPHTTFFLTHVCFLFYHVASNITLRRLRHSTADLPDSLKWCFEAAWILALSYFIAYLETIAIANFPYYEFVDRSAMYRVGCLFYAIYFIVSFPMFFRMDEKSTDEWDLSRVAVDALGAAMLVTIILDLWRLFLGPIVPLPEGQNCLQSGLPWFSN

SEQ ID NO: 51089 - protein, 276 aa, Arabidopsis thaliana; identical to SEQ ID NO: 9419
  misc_feature: Useful for making plants with modulated drought sensitivity

SEQ ID NO: 51090 - protein, 254 aa, Arabidopsis thaliana
  misc_feature: Useful for making plants with modulated biomass
  misc_feature: Useful for making plants with modulated flowering time
MEDLDHEYKNYWETTMFFQNQELEFDSWPMEEAFSGSGESSSPDGAATSPASSKNVVSERNRRQKLNQRLFALRSVVPNISKLDKASVIKDSIDYMQELIDQEKTLEAEIRELESRSTLLENPVRDYDCNFAETHLQDFSDNNDMRSKKFKQMDYSTRVQHYPIEVLEMKVTWMGEKTVVVCITCSKKRETMVQLCKVLESLNLNILTTNFSSFTSRLSTTLFLQADEEESSAVEAKIQMAIAAYNDPNCLINF

SEQ ID NO: 51091 - protein, 300 aa, Arabidopsis thaliana
  misc_feature: Useful for making plants with altered lignin content
MNFTGLNHSVPDFLPAPENSSGSCGLSPLFSNRAKVLKPLQVMASSGSQPTLFQKRAAMRQSSTSKSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 51092 - protein, 494 aa, Arabidopsis thaliana
  misc_feature: Useful for making plants with modulated cold sensitivity
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 51093 - protein, 234 aa, Oryza sativa
  misc_feature: Useful for biocontainment applications
MPRRARARGGGGGGGEEVKVEDDFIDSVLNFGGGGGGEEDGDDGEEEQQQQQAAAAAMGKEFKSKNLEAERRRRGRLNGNIFALRAVVPKITKMSKEATLSDAIEHIKNLQNEVLELQRQLGDSPGEAWEKQCSASCSESFVPTENAHYQGQVELISLGSCKYNLKIFWTKRAGLFTKVLEALCSYKVQVLSLNTISFYGYAESFFTIEVKGEQDVVMVELRSLLSSIVEVPSI

SEQ ID NO: 51094 - protein, 235 aa, Arabidopsis thaliana; identical to SEQ ID NO: 9674
  misc_feature: Useful for making plants with modulated nitrogen use efficiency

SEQ ID NO: 51095 - protein, 219 aa, Arabidopsis thaliana; identical to SEQ ID NO: 9573
  misc_feature: Useful for making plants with modulated heat sensitivity

SEQ ID NO: 51096 - protein, 148 aa, Arabidopsis thaliana
  misc_feature: Useful for making plants with modulated water use efficiency
MATQISKKRKFVADGVFYAELNEVLTRELAEDGYSGVEVRVTPMRTEIIIRATRTQNVLGEKGRRIRELTSLVQKRFKFPQDSVELYAEKVANRGLCAIAQAESLRYKLLGGLAVRRACYGVLRFVMESGAKGCEVIVSGKLRAARAK

SEQ ID NO: 51097 - protein, 229 aa, Zea mays; identical to SEQ ID NO: 9400
  misc_feature: Useful for making plants with modulated biomass

SEQ ID NO: 51098 - protein, 421 aa, Arabidopsis thaliana; identical to SEQ ID NO: 9525
  misc_feature: Useful for making plants with modulated biomass

SEQ ID NO: 51099 - protein, 564 aa, Panicum virgatum; identical to SEQ ID NO: 2920
  misc_feature: Useful for making plants with altered carbohydrate content

SEQ ID NO: 51100 - protein, 338 aa, Panicum virgatum; identical to SEQ ID NO: 5632
  misc_feature: Useful for making plants with altered carbohydrate content

SEQ ID NO: 51101 - protein, 323 aa, Arabidopsis thaliana
  misc_feature: Useful for making plants with altered cell wall content and/or composition
MAETIGSEVSSMSDKSAKIFVAGHRGLVGSAIVRKLQEQGFTNLVLKTHAELDLTRQADVESFFSQEKPVYVILAAAKVGGIHANNTYPADFIGVNLQIQTNVIHSAYEHGVKKLLFLGSSCIYPKFAPQPIPESALLTASLEPTNEWYAIAKIAGIKTCQAYRIQHGWDAISGMPTNLYGPNDNFHPENSHVLPALMRRFHEAKVNGAEEVVVWGTGSPLREFLHVDDLADACVFLLDRYSGLEHVNIGSGQEVTIRELAELVKEVVGFEGKLGWDCTKPDGTPRKLMDSSKLASLGWTPKVSLRDGLSQTYDWYLKNVCNR

SEQ ID NO: 51102 - protein, 221 aa, Arabidopsis thaliana
  misc_feature: Useful for making plants with altered cell wall content and/or composition
MIYLDGDIQVFDNIDHLFDLPNGQFYAVMDCFCEKTWSHSPQYKIGYCQQCPDKVTWPEAKLGPKPPLYFNAGMFVYEPNLSTYHNLLETVKIVPPTLFAEQDFLNMYFKDIYKPIPPVYNLVLAMLWRHPENIELDQVKVVHYCAAGAKPWRFTGEEENMDREDIKMLVKKWWDIYNDESLDYKNVVIGDSHKKQQTLQQFIEALSEAGALQYVKAPSAA

SEQ ID NO: 51103 - protein, 365 aa, Arabidopsis thaliana; identical to SEQ ID NO: 9574
  misc_feature: Useful for making plants with modulated drought sensitivity
  misc_feature: Useful for making plants with modulated water use efficiency

SEQ ID NO: 51104 - protein, 497 aa, Arabidopsis thaliana
  misc_feature: Useful for making plants with altered cell wall content and/or composition
MIIYLISLLPIIVATLMLYQRWWRSNIPPGPKPKFLLGNLHQMKPLWTHSFSEWSETYGPIISVWIGSQLTVVVSSSDLARQVLRDKDHQLSNRHRIARMTQTGTDLVWSDYSPHYVKLRKLCTLELFSLKSIENFRSLREMEARSMVVSILKDLMSNSGDDQERKPVIVRKYLAAVVLNTISRLMIGKEFGSEEGKEFKAIVEKEHLLSGSGTILDHVWWLKWVSSWFFSDKEFLAHKDRRTKWFRGAIMVEEDIEIEDHRGFVRKLLVLKEQKELSEETVGGLVWNMLTAGADTTAVVIEWAMAEMIKCPTVQEKAQQELDSVVGSERLMTESDIPILPYLQCVVKEALRLHPSTPLMLPHKASETVWVGGYKVPKGATVYVNVQAIGRDPANWINPYEFRPERFLQEETDVKGRDFRVLPFGSGRRMCPAAQLSMNLMTLVMGNLLHCFSWSSPVPGERIDMSENPGLLCNMRTPLQALALPRAAARAIPLPLD

SEQ ID NO: 51105 - protein, 283 aa, Arabidopsis thaliana; identical to SEQ ID NO: 9549
  misc_feature: Useful for making plants with modulated nitrogen use efficiency

SEQ ID NO: 51106 - protein, 213 aa, Arabidopsis thaliana
  misc_feature: Useful for making plants with altered cell wall content and/or composition
MGSVEAGEKKALGWAARDPSGVLSPYSYTLRSTGADDVYIKVICCGICHTDIHQIKNDLGMSNYPMVPGHEVVGEVLEVGSDVSKFTVGDVVGVGVVVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISS

SEQ ID NO: 51107 - protein, 491 aa, Panicum virgatum; identical to SEQ ID NO: 4010
  misc_feature: Useful for making plants with altered carbohydrate content

SEQ ID NO: 51108 - protein, 346 aa, Zea mays; identical to SEQ ID NO: 9420
  misc_feature: Useful for making plants with modulated cold sensitivity

SEQ ID NO: 51109 - protein, 315 aa, Arabidopsis thaliana
  misc_feature: Useful for making plants with modulated biomass
  misc_feature: Useful for making plants with modulated flowering time
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 51110 - protein, 310 aa, Arabidopsis thaliana
  misc_feature: Useful for making plants with modulated light quality response
MANPWWVGNVAIGGVESPVTSSAPSLHHRNSNNNNPPTMTRSDPRLDHDFTTNNSGSPNTQTQSQEEQNSRDEQPAVEPGSGSGSTGRRPRGRPPGSKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEEEQQQEQPLQLEDGKKQKEENDDNESGNNGNEGSMQPPMYNMPPNFIPNGHQMAQHDVYWGGPPPRAPPSY

SEQ ID NO: 51111 - protein, 277 aa, Glycine max
  misc_feature: Useful for making plants with modulated flowering time
  misc_feature: Useful for making plants with modulated light quality response
  misc_feature: Useful for making plants with modulated low light sensitivity
MKGEYVEQQQQHPKSETPPSMFSKLQPQHHPFPHHPFQLSAEDATTITPSTAQKANSSGGDGATIEVVRRPRGRPPGSKNKPKPPVIITRDPEPAMSPYILEVSGGNDVVEAIAQFSHRKNMGICVLTGSGTVANVTLRQPSTTPGTTVTFHGRFDILSVSATFLPQQSGASPAVPNGFAISLAGPQGQIVGGLVAGGLMAAGTVFVIAASFNNPAYHRLPPEEEGASAGDGHSPPVSGGGDSGHGQAESCGMSMYSCHLPSDVIWAPTARPPPPPY

SEQ ID NO: 51112 - protein, 565 aa, Arabidopsis thaliana
  misc_feature: Useful for making plants with altered cell wall content and/or composition
SAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQQHKQGTEDEHSSSLLESYELLIHMGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQQHKQGTEDEHSSSLLESYELLIHLRWINYLRPDVKRGNFSAEEEDTIIKLHQSFGNKWSKIASKLPGLRWINYLRPDVKRGNFSAEEEDTIIKLHQSFGNKWSKIASKLPGR

SEQ ID NO: 51113 - protein, 272 aa, Arabidopsis thaliana
  misc_feature: Useful for making plants with altered alkaloid content
  misc_feature: Useful for making plants with altered lignin content
  misc_feature: Useful for making plants with modulated nitrogen use efficiency
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEDDEVDKWFKHLESELGLEENDNQQQQHKQGTEDEHSSSLLESYELLIH

SEQ ID NO: 51114 - protein, 271 aa, Panicum virgatum; identical to SEQ ID NO: 7156
  misc_feature: Useful for making plants with altered carbohydrate content

SEQ ID NO: 51115 - protein, 443 aa, Arabidopsis thaliana
  misc_feature: Useful for making plants with altered cell wall content and/or composition
MASPNWPSLLMVVLALYSMVAYTSAQYSPTPTPYSPLPPYVYNSPPPYVYNSPSPPPYVYKPPPYIYSSPPPPPYVYSSPPPPPYVYNSPPPPPYVYSSPPPPPYVYKSPPPPPYVYSSPPPPPYVYKSPPPPPYVYSSPPPPPYVYSSPPPPPYVYKSPPPPPYVYSPPPPPPYVYQSPPPPPYVYSSPPPPPYVYKSPPPPPYVYSSPPPPPYVYKSPPPPPYVYSSPPPPPYVYKSPPPPPYVYSSPPPPPYVYKSPPPPPYVYSSPPPPPYVYKSPPPPPYVYSSPPPPPYVYSSPPPPPYVYSSPPPPPYVYKSPPPPPYVYTSPPPPPYVYKSPPPPPYVDSYSPPPAPYVYKPPPYVYKPPPYVYNYSPPPAPYVYKPPPYVYSYSPPPAPYVYKPPPYVYSYSPPPAPYVYKPPPYVYSSPSPPPYYSSPSPPLY

SEQ ID NO: 51116 - protein, 188 aa, Zea mays; identical to SEQ ID NO: 9468
  misc_feature: Useful for making plants with modulated oxidative stress sensitivity

SEQ ID NO: 51117 - protein, 347 aa, Arabidopsis thaliana; identical to SEQ ID NO: 9684
  misc_feature: Useful for making plants with modulated salt sensitivity

SEQ ID NO: 51118 - protein, 517 aa, Panicum virgatum; identical to SEQ ID NO: 24115
  misc_feature: Useful for making plants with altered carbohydrate content

SEQ ID NO: 51119 - protein, 589 aa, Arabidopsis thaliana
  misc_feature: Useful for making plants with altered carbon content
  misc_feature: Useful for making plants with altered nitrogen content
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 51120 - protein, 538 aa, Arabidopsis thaliana; identical to SEQ ID NO: 9430
  misc_feature: Useful for making plants with modulated water use efficiency

SEQ ID NO: 51121 - protein, 538 aa, Arabidopsis thaliana; identical to SEQ ID NO: 9430
  misc_feature: Useful for making plants with modulated drought sensitivity

SEQ ID NO: 51122 - protein, 464 aa, Arabidopsis thaliana; identical to SEQ ID NO: 9186
  misc_feature: Useful for making plants with modulated nitrogen use efficiency

SEQ ID NO: 51123 - protein, 410 aa, Panicum virgatum; identical to SEQ ID NO: 24206
  misc_feature: Useful for making plants with altered carbohydrate content

SEQ ID NO: 51124 - protein, 669 aa, Arabidopsis thaliana
  misc_feature: Useful for making plants with altered cell wall content and/or composition
MASYTPKNILITGAAGFIASHVANRLIRSYPDYKIVVLDKLDYCSNLKNLNPSKHSPNFKFVKGDIASADLVNHLLITEGIDTIMHFAAQTHVDNSFGNSFEFTKNNIYGTHVLLEACKVTGQIRRFIHVSTDEVYGETDEDALVGNHEASQLLPTNPYSATKAGAEMLVMAYGRSYGLPVITTRGNNVYGPNQFPEKLIPKFILLAMRGQVLPIHGDGSNVRSYLYCEDVAEAFEVVLHKGEVGHVYNIGTKKERRVNDVAKDICKLFNMDPEANIKFVDNRPFNDQRYFLDDQKLKKLGWSERTTWEEGLKKTMDWYTQNPEWWGDVSGALLPHPRMLMMPGGRHFDGSEDNSLAATLSEKPSQTHMVVPSQRSNGTPQKPSLKFLIYGKTGWIGGLLGKICDKQGIAYEYGKGRLEDRSSLLQDIQSVKPTHVFNSAGVTGRPNVDWCESHKTETIRANVAGTLTLADVCREHGLLMMNFATGCIFEYDDKHPEGSGIGFKEEDTPNFTGSFYSKTKAMVEELLKEYDNVCTLRVRMPISSDLNNPRNFITKISRYNKVVNIPNSMTVLDELLPISIEMAKRNLKGIWNFTNPGVVSHNEILEMYRDYINPEFKWANFTLEEQAKVIVAPRSNNEMDASKLKKEFPELLSIKESLIKYAYGPNKKT

SEQ ID NO: 51125 - protein, 668 aa, Panicum virgatum; identical to SEQ ID NO: 3128
  misc_feature: Useful for making plants with altered carbohydrate content

SEQ ID NO: 51126 - protein, 628 aa, Arabidopsis thaliana
  misc_feature: Useful for making plants with modulated biomass
MMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 51127 - protein, 518 aa, Arabidopsis thaliana
  misc_feature: Useful for making plants with modulated low light sensitivity
MDMYNNNIGMFRSLVCSSAPPFTEGHMCSDSHTALCDDLSSDEEMEIEELEKKIWRDKQRLKRLKEMAKNGLGTRLLLKQQHDDFPEHSSKRTMYKAQDGILKYMSKTMERYKAQGFVYGIVLENGKTVAGSSDNLREWWKDKVRFDRNGPAAIIKHQRDINLSDGSDSGSEVGDSTAQKLLELQDTTLGALLSALFPHCNPPQRRFPLEKGVTPPWWPTGKEDWWDQLSLPVDFRGVPPPYKKPHDLKKLWKIGVLIGVIRHMASDISNIPNLVRRSRSLQEKMTSREGALWLAALYREKAIVDQIAMSRENNNTSNFLVPATGGDPDVLFPESTDYDVELIGGTHRTNQQYPEFENNYNCVYKRKFEEDFGMPMHPTLLTCENSLCPYSQPHMGFLDRNLRENHQMTCPYKVTSFYQPTKPYGMTGLMVPCPDYNGMQQQVQSFQDQFNHPNDLYRPKAPQRGNDDLVEDLNPSPSTLNQNLGLVLPTDFNGGEETVGTENNLHNQGQELPTSWIQ

SEQ ID NO: 51128 - protein, 541 aa, Arabidopsis thaliana; identical to SEQ ID NO: 9744
  misc_feature: Useful for making plants with modulated biomass

SEQ ID NO: 51129 - protein, 491 aa, Arabidopsis thaliana
  misc_feature: Useful for making plants with altered cell wall content and/or composition
MLTSTYNRNQVLGFMTLILTLMSLSEARNHHHKEKHKHNNHNHHSSKPKPPSSSISQPPTPPPGPPDSPAPSLPPSPSDDPADDNNGIYNVRKYGAVGDGETDDTEAFKTAWDSSCNNENNTDSVLLVPYGYTFMIQSTIFTGPCRSYQFFQVDGTIVTPDGPESWPSNISKRQWLVFYRVNGMALKGEGVIDGRGQKWWDLPCKPHRSVNKSAIVTGPCDSPIALRFFMSSNLRVEGLQIKNSPQFHFRFDGCQGVHVESLHITAPPLSPNTDGIHIENSNSVTIYNSIISNGDDCVSIGSGSYDVDIRNLTCGPGGHGISIGSLGNHNSRACVSNITVRDSVIKYSDNGVRIKTWQGGSGSVSGVTFNNIHVDSVRNPIIIDQYYCMTKDCANKTSAVFVSDIAYQGIKGTYDIRSPPMHFGCSDAVPCTNLTLSDIELLPAKGEIVLDPFCWNAYGIAEELSIPPVWCLMSDPPKGLQGSLVDKCGSS

SEQ ID NO: 51130 - protein, 658 aa, Panicum virgatum; identical to SEQ ID NO: 6278
  misc_feature: Useful for making plants with altered carbohydrate content

SEQ ID NO: 51131 - protein, 485 aa, Panicum virgatum; identical to SEQ ID NO: 6052
  misc_feature: Useful for making plants with altered carbohydrate content

SEQ ID NO: 51132 - protein, 523 aa, Arabidopsis thaliana
  misc_feature: Useful for making plants with altered cell wall content and/or composition
MESLMRLVLVLFPFFVVFFVPLDHVSSESISRANFPDGFVFGTASSAYQFEGAVKEGNKGESIWDTFTKEKPGKILDFSNADTTVDQYHRFHNDIDLMKDLRMDAYRFSISWSRIFPNGTGEVNPDGVKYYNSLIDALLAKGIKPYVTLYHWDLPQALEDRYEGWLSREVVDDFEHYAFTCFKAFGDRVKYWITFNEPHGVSIQGYDTGIQAPGRCSLLGHWFCKKGKSSVEPYIVAHNILLSHAAAYHTYQRNFKEKQRGQIGISLDAKWYEPMSDCDEDKDAARRAMDFGLGWFMDPLINGDYPASMKSLVEERLPKITPEMYKTIKGAFDYVGINHYTTLYARNDRTRIRKLILQDASSDSAVITSWSSWLHIVPWGIRKLAVYVKDIYGNPPVFITENGMDEKNSPFIDMEKALKDDKRIGFHRDYLSNLSAAIRNDECDVRGYFVWSLLDNWEWNSGYTVRFGIYYVDYKNNLTRIPKASARWFQTILSGSSSTSDSSKLILLEEATEQQQEYKFQEK

SEQ ID NO: 51133 - protein, 1107 aa, Arabidopsis thaliana
  misc_feature: Useful for making plants with modulated cold sensitivity
MGRSKLASRPAEEDLNPGKSKRKKISLGPENAAASISTGIEAGNERKPGLYCCNYCDKDLSGLVRFKCAVCMDFDLCVECFSVGVELNRHKNSHPYRVMDNLSFSLVTSDWNADEEILLLEAIATYGFGNWKEVADHVGSKTTTECIKHFNSAYMQSPCFPLPDLSHTIGKSKDELLAMSKDSAVKTEIPAFVRLSPKEELPVSAEIKHEASGKVNEIDPPLSALAGVKKKGNVPQAKDIIKLEAAKQQSDRSVGEKKLRLPGEKVPLVTELYGYNLKREEFEIEHDNDAEQLLADMEFKDSDTDAEREQKLQVLRIYSKRLDERKRRKEFVLERNLLYPDQYEMSLSAEERKIYKSCKVFARFQSKEEHKELIKKVIEEHQILRRIEDLQEARTAGCRTTSDANRFIEEKRKKEAEESMLLRLNHGAPGSIAGKTLKSPRGLPRNLHPFGSDSLPKVTPPRIYSGLDTWDVDGLLGADLLSETEKKMCNETRILPVHYLKMLDILTREIKKGQIKKKSDAYSFFKVEPSKVDRVYDMLVHKGIGDSTNLPGRSASLVPMGRSKLASRPAEEDLNPGKSKRKKISLGPENAAASISTGIEAGNERKPGLYCCNYCDKDLSGLVRFKCAVCMDFDLCVECFSVGVELNRHKNSHPYRVMDNLSFSLVTSDWNADEEILLLEAIATYGFGNWKEVADHVGSKTTTECIKHFNSAYMQSPCFPLPDLSHTIGKSKDELLAMSKDSAVKTEIPAFVRLSPKEELPVSAEIKHEASGKVNEIDPPLSALAGVKKKGNVPQAKDIIKLEAAKQQSDRSVGEKKLRLPGEKVPLVTELYGYNLKREEFEIEHDNDAEQLLADMEFKDSDTDAEREQKLQVLRIYSKRLDERKRRKEFVLERNLLYPDQYEMSLSAEERKIYKSCKVFARFQSKEEHKELIKKVIEEHQILRRIEDLQEARTAGCRTTSDANRFIEEKRKKEAEESMLLRLNHGAPGSIAGKTLKSPRGLPRNLHPFGSDSLPKVTPPRIYSGLDTWDVDGLLGADLLSETEKKMCNETRILPVHYLKMLDILTREIKKGQIKKKSDAYSFFKVEPSKVDRVYDMLVHKGIGDST

SEQ ID NO: 51134 - protein, 501 aa, Arabidopsis thaliana
  misc_feature: Useful for making plants with altered cell wall content and/or composition
MFLFLLLLSASRSGEESPSGDAVPLATGGLNRKSFPEGFLFGTATSAYQVEGETHQDGRGPSIWDAFVKIPGKIANNATAEITVDQYHRYKEDVDLMQNLNIDAYRFSISWSRIFPEGSGKINSNGVAYYNRLIDYLIEKGITPYANLYHYDLPLALEQKYQGLLSKQGRFCGLRRVLFQTFGDRVKNWMTFNEPRVVAALGYDNGIFAPGRCSEAFGNCTDGNSATEPYIVAHHLILAHAAAVQRYRQNYQEKQKGRVGILLDFVWFEPLTSSQADNDAAQRARDFHVGWFIHPIVYGEYPNTLQNIVKERLPKFTEEEVKMVKGSIDFVGINQYTTYFMSDPKISTTPKDLGYQQDWNVTFNFAKNGTPIGPRAHSEWLYNVPWGMYKALMYIEERYGNPTMILSENGMDDPGNITLTQGLNDTTRVKYYRDYLVQLKKAVDDGANLTGYFAWSLLDNFEWLSGYTSRFGIVYVDYKDLKRYPKMSALWFKQLLKRDQK

SEQ ID NO: 51135 - protein, 480 aa, Panicum virgatum; identical to SEQ ID NO: 1636
  misc_feature: Useful for making plants with altered carbohydrate content

SEQ ID NO: 51136 - protein, 664 aa, Arabidopsis thaliana
  misc_feature: Useful for making plants with altered cell wall content and/or composition
MATYKPKNILITGAAGFIASHVANRLVRSYPDYKIVVLDKLDYCSNLKNLNPSKSSPNFKFVKGDIASADLVNYLLITEEIDTIMHFAAQTHVDNSFGNSFEFTKNNIYGTHVLLEACKVTGQIRRFIHVSTDEVYGETDEDASVGNHEASQLLPTNPYSATKAGAEMLVMAYGRSYGLPVITTRGNNVYGPNQFPEKLIPKFILLAMNGKPLPIHGDGSNVRSYLYCEDVAEAFEVVLHKGEVNHVYNIGTTRERRVIDVANDISKLFGIDPDSTIQYVENRPFNDQRYFLDDQKLKKLGWCERTNWEEGLRKTMEWYTENPEWWGDVSGALLPHPRMLMMPGDRHSDGSDEHKNADGNQTFTVVTPTKAGCSGDKRSLKFLIYGKTGWLGGLLGKLCEKQGIPYEYGKGRLEDRASLIADIRSIKPSHVFNAAGLTGRPNVDWCESHKTETIRVNVAGTLTLADVCRENDLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPDFKWSNFNLEEQAKVIVAPRSNNEMDGAKLSKEFPEMLSIKDSLIKYVFEPNKRT

SEQ ID NO: 51137 - protein, 1051 aa, Arabidopsis thaliana; identical to SEQ ID NO: 9251
  misc_feature: Useful for making plants with altered lignin content

SEQ ID NO: 51138 - protein, 490 aa, Arabidopsis thaliana
  misc_feature: Useful for making plants with altered cell wall content and/or composition
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVA

SEQ ID NO: 51139 - protein, 707 aa, Arabidopsis thaliana
  misc_feature: Useful for making plants with altered cell wall content and/or composition
MELCNQNNHITAVSGDPLNWNATAEALKGSHLDEVKRMVKEYRKEAVKLGGETLTIGQVAAVARGGGGSTVELAEEARAGVKASSEWVMESMNRGTDSYGVTTGFGATSHRRTKQGGALQNELIRFLNAGIFGPGAGDTSHTLPKPTTRAAMLVRVNTLLQGYSGIRFEILEAITKLLNHEITPCLPLRGTITASGDLVPLSYIAGLLTGRPNSKAVGPSGETLTASEAFKLAGVSSFFELQPKEGLALVNGTAVGSGLASTVLFDANILAVLSEVMSAMFAEVMQGKPEFTDHLTHKLKHHPGQIEAAAIMEHILDGSSYVKEAQLLHEMDPLQKPKQDRYALRTSPQWLGPQIEVIRAATKMIEREINSVNDNPLIDVSRNKALHGGNFQGTPIGVAMDNSRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSTTYLVALCQAVDLRHLEENLKKAVKSAVSQVAKRVLTVGANGELHPSRFTERDVLQVVDREYVFSYADDPCSLTYPLMQKLRHILVDHALADPEREANSATSVFHKIGAFEAELKLLLPKEVERVRVEYEEGTSAIANRIKECRSYPLYRFVRDELNTELLTGENVRSPGEEFDKVFLAISDGKLIDPLLECLKEWNGAPVSIC

SEQ ID NO: 51140 - protein, 874 aa, Panicum virgatum; identical to SEQ ID NO: 24482
  misc_feature: Useful for making plants with altered carbohydrate content

SEQ ID NO: 51141 - protein, 305 aa, Lycopersicon peruvianum
  misc_feature: Useful for making plants with modulated biotic stress sensitivity
TNSINDALSSSYLVPFESYRVPLVDLEEATNNFDDKFFIGHGVFGKVYKGVLRDGTKVALKRRQPESSQGIEEFETEIETLSFCRHPHLVSLIGFCDERNEMVLIYKYMENGNLKRYLYGSDLPTMSMSWEQRLEICIGAARGLHYLHTRAVIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNKGQLEQIVDPNLADKIRPESLRKFGETAVKCLALSSEDRPSMGDVLWKLEYA

SEQ ID NO: 51142 - protein, 352 aa, Panicum virgatum; identical to SEQ ID NO: 496
  misc_feature: Useful for making plants with altered carbohydrate content

SEQ ID NO: 51143 - protein, 490 aa, Arabidopsis thaliana
  misc_feature: Useful for making plants with altered cell wall content and/or composition
MAQKLNLLNLAVPPVTHRSNFPSTFTFGVATSAYQIEGGWNEGKKGPSIWDKFTHIEGKILDGSNGDVAVDHYHRYKEDVDLIGQLGFGAYRFSISWSRIFPDGLGTEVNEEGIAFYNDLINTLLEKGIQPYVTLYHWDLPSHLQEAIGGWTNRKIVDYFGLYADACFANFGDRVKHWITLNEPLQTSVNGHCIGIFAPGRNEKPLIEPYLVSHHQVLAHATAVSIYRSKYKESQGGQIGLSVDCEWAEPNSEKPEDKVAADRRIDFQLGWFLDPLFFGDYPASMRQKLGDNLPRFTPEEKEFMLQNSWDFLGLNHYTSRLISHVSNKEAESNFYQAQELERIVELENGDLIGERAASDWLYAVPWGIRKTLNYMSKKYNHPPIFITENGMDDEDDGSASIHDMLDDKRRVDYFKSYLANVSQAIEDGVDIKGYFAWSLLDNFEWAQGYTKRFGLVYVDYKNGLTRHPKSSAYWFMKFLKGDEENKGKKE

SEQ ID NO: 51144 - protein, 754 aa, Arabidopsis thaliana
  misc_feature: Useful for making plants with modulated flowering time
MASSSSSSSSITIITTFLFLLLHTTAKKTYIIRVNHSDKPESFLTHHDWYTSQLNSESSLLYTYTTSFHGFSAYLDSTEADSLLSSSNSILDIFEDPLYTLHTTRTPEFLGLNSEFGVHDLGSSSNGVIIGVLDTGVWPESRSFDDTDMPEIPSKWKGECESGSDFDSKLCNKKLIGARSFSKGFQMASGGGFSSKRESVSPRDVDGHGTHTSTTAAGSAVRNASFLGYAAGTARGMATRARVATYKVCWSTGCFGSDILAAMDRAILDGVDVLSLSLGGGSAPYYRDTIAIGAFSAMERGVFVSCSAGNSGPTRASVANVAPWVMTVGAGTLDRDFPAFANLGNGKRLTGVSLYSGVGMGTKPLELVYNKGNSSSSNLCLPGSLDSSIVRGKIVVCDRGVNARVEKGAVVRDAGGLGMIMANTAASGEELVADSHLLPAIAVGKKTGDLLREYVKSDSKPTALLVFKGTVLDVKPSPVVAAFSSRGPNTVTPEILKPDVIGPGVNILAGWSDAIGPTGLDKDSRRTQFNIMSGTSMSCPHISGLAGLLKAAHPEWSPSAIKSALMTTAYVLDNTNAPLHDAADNSLSNPYAHGSGHVDPQKALSPGLVYDISTEEYIRFLCSLDYTVDHIVAIVKRPSVNCSKKFSDPGQLNYPSFSVLFGGKRVVRYTREVTNVGAASSVYKVTVNGAPSVGISVKPSKLSFKSVGEKKRYTVTFVSKKGVSMTNKAEFGSITWSNPQHEVRSPVAFSWNRF

SEQ ID NO: 51145 - protein, 571 aa, Panicum virgatum; identical to SEQ ID NO: 5926
  misc_feature: Useful for making plants with altered carbohydrate content

SEQ ID NO: 51146 - protein, 613 aa, Arabidopsis thaliana; identical to SEQ ID NO: 9743
  misc_feature: Useful for making plants with modulated biomass
  misc_feature: Useful for making plants with modulated flowering time

SEQ ID NO: 51147 - protein, 604 aa, Arabidopsis thaliana
  misc_feature: Useful for making plants with altered protein content
MNLGAWGQRFIQAAASSESEDSALDLERNHHCNHLSLPSSSSPSPLQPFTLNIQHAESNAPYFSWPTLSRLNDTVEDRANYFGNLQKGVLPETVGRLPSGQQATTLLELMTIRAFHSKILRRFSLGTAVGFRISRGVLTNVPAILVFVARKVHRQWLNPMQCLPSALEGPGGVWCDVDVVEFQYYGAPAATPKEQVYNELVDGLRGSDPCIGSGSQVASQETYGTLGAIVKSRTGNHQSGYTSDFAEHNQSSHEEESTNYCADFTNQSSNLWPHHNQWVAFSAESSSMKRVDEWVRGLDVETVVPVNEDKDVLAIFPTSPNTERSPLGNVVQSGNVSEAIVHANSLIQSLSKSSSVAHISSIGLKAIPSISHFTSLKSIDLSNNFIVQITPASLPKGLHALNLSKNKISVIEGLRDLTRLRVLDLSYNRISRIGQGLSNCTLIKELYLAGNKISNVEGLHRLLKLIVLDLSFNKIATTKAIGQLVANYNSLVALNILGNPIQNNVGEDQLRKTVSSLLPKLVYHNKQLIKPQRAREVLKDSVARAAFGGGDSLHHRRKRTSTKSVVGSASPSVHHRGHIAKGRGSKNRSQRQLRKTSAAGTPSH

SEQ ID NO: 51148 - protein, 267 aa, Arabidopsis thaliana
  misc_feature: Useful for making plants with altered alkaloid content
MEGYSRNGEISPKLLDLMIPQERRNSFHDEKNSVFKTEEKKLELKLGPPGEEDDDESIIRHMKKEPKDKSILSLAGKHFSPSSTKTTSHKRTAPGPVVGWPPVRSFRKNLASGSSSKLGNDSTTSNGVTLKNQKCDDAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 51149 - protein, 496 aa, Panicum virgatum; identical to SEQ ID NO: 24642
  misc_feature: Useful for making plants with altered carbohydrate content

SEQ ID NO: 51150 - protein, 560 aa, Panicum virgatum; identical to SEQ ID NO: 786
  misc_feature: Useful for making plants with altered carbohydrate content

SEQ ID NO: 51151 - protein, 847 aa, Arabidopsis thaliana
  misc_feature: Useful for making plants with altered cell wall content and/or composition
MGSKPNAMKNVVAMAAVSALFLLGFLVCSVSGSVSYDSRAITINGKRRILISGSIHYPRSTPEMWPDLIRKAKEGGLDVIQTYVFWNGHEPSPGKYYFEGNYDLVKFVKLVQQSGLYLHLRIGPYVCAEWNFGGFPVWLKYIPGISFRTDNGPFKAQMQRFTTKIVNMMKAERLFESQGGPIILSQIENEYGPMEYELGAPGRSYTNWAAKMAVGLGTGVPWVMCKQDDAPDPIINACNGFYCDYFSPNKAYKPKMWTEAWTGWFTKFGGPVPYRPAEDMAFSVARFIQKGGSFINYYMYHGGTNFGRTAGGPFIATSYDYDAPLDEYGLERQPKWGHLKDLHRAIKLCEPALVSGEPTRMPLGNYQEAHVYKSKSGACSAFLANYNPKSYAKVSFGNNHYNLPPWSISILPDCKNTVYNTARVGAQTSRMKMVRVPVHGGLSWQAYNEDPSTYIDESFTMVGLVEQINTTRDTSDYLWYMTDVKVDANEGFLRNGDLPTLTVLSAGHAMHVFINGQLSGSAYGSLDSPKLTFRKGVNLRAGFNKIAILSIAVGLPNVGPHFETWNAGVLGPVSLNGLNGGRRDLSWQKWTYKVGLKGESLSLHSLSGSSSVEWAEGAFVAQKQPLTWYKTTFSAPAGDSPLAVDMGSMGKGQIWINGQSLGRHWPAYKAVGSCSECSYTGTFREDKCLRNCGEASQRWYHVPRSWLKPSGNLLVVFEEWGGDPNGITLVRREVDSVCADIYEWQSTLVNYQLHASGKVNKPLHPKAHLQCGPGQKITTVKFASFGTPEGTCGSYRQGSCHAHHSYDAFNKLCVGQNWCSVTVAPEMFGGDPCPNVMKKLAVEAVCA

SEQ ID NO: 51152 - protein, 572 aa, Panicum virgatum
  misc_feature: Useful for making plants with altered carbohydrate content
MPGGAALLLAPLLAALAAAAVGPSPANAAVSYDHRAVVINGQRRILISGSIHYPRSAPEMWPDLLQKAKDGGLDVVQTYVFWNGHEPVQGQFYFGDRYDLVRFVKLAHQAGLYVHLRIGPYVCAEWNFGGFPVWLKYVPEISFRTDNGPFKAAMQAFVEKVVSMMKAEGLFEWQGGPVILAQVENEYGPMEPSMGAGAKPYAAWAARMAVATGAGVPWVMCKQDDAPDPVINTCNGFYCDYFSPNSNSKPTMWTEAWSGWFTAFGKPVPHRPVEDLAFAVARFIQKGGSFVNYYMYHGGTNFDRTSGGPFIATSYDYDAPIDEYGLLRQPKWGHLKDLHAAIKQAEPALVAGDPTVQSLGNYEKAYVFKSSGGACAAFLSNYKTDAAATVAFNGRRYELPAWSISVLPDCKTAVFNTATVRAPSAPARMSPAAAGLAWRSYGEATNALDSRAFTKDGLVEQLGMTWDKSDYLWYTTYVNIDSNEQFLKSGKWPQLTIYSAGHALQVFVNGQSYGAAYGGYDSPKLTYSGYVKMWQGSNKISILSAAVGLPVSSAHRHHCHSISSPSSELRQP

SEQ ID NO: 51153 - protein, 528 aa, Panicum virgatum; identical to SEQ ID NO: 24693
  misc_feature: Useful for making plants with altered carbohydrate content

SEQ ID NO: 51154 - protein, 622 aa, Arabidopsis thaliana
  misc_feature: Useful for making plants with altered protein content
MAMAVFKAPLKGEFHGARKMEGKQYKHHLLQQQSTGRRRVFVQTDTGCVLGVELDRNDNVHTVKKRLQIAFNFPTEESSLTFGDMVLKNDLSAVRNDSPLLLKRNLMHRSSSTPCLSPTGNDLQRKDRSGPIEILSHSPCFLSLKQTANDIVKAMKMGVEPIPVNGGLGGAYYFRDEKGQSVAIVKPTDEEPFAPNNPKGFVGKALGQPGLKPSVRVGETGFREVAAYLLDYDHFANVPPTALVKITHSVFNVNDGMDGNKSREKKKLVSSKIASFQKFVPHDFDASDHGTSSFPVASVHRIGILDIRILNTDRHGGNLLVKKLDDGGVGRFGQVELIPIDHGLCLPETLEDPYFEWIHWPQASIPFSEEELDYIQSLDPVKDCEMLRRELPMIREACLRVLVLCTVFLKEAAVFGLCLAEIGEMMTREFRAGEEEPSELEMLCIEAKRLTTEQDVLSPKSDGEGETEFQFDIDYNELDSVYGSETETDEFFAKNPFSNGRSSLGELKESIAEEEEDDEEEAKLTLSLSKLSTSMKNNLSNTMGSGYLKPPKDNQTDKALVSHKSANVQLPLSVNFVKLADMKEVEWVVFLERFQELLYSAFAERKTMTLRNTQRLGTSCKF

SEQ ID NO: 51155 - protein, 443 aa, Panicum virgatum; identical to SEQ ID NO: 4396
  misc_feature: Useful for making plants with altered carbohydrate content

SEQ ID NO: 51156 - protein, 558 aa, Arabidopsis thaliana; identical to SEQ ID NO: 9757
  misc_feature: Useful for making plants with modulated biomass
  misc_feature: Useful for making plants with modulated flowering time

SEQ ID NO: 51157 - protein, 265 aa, Arabidopsis thaliana
  misc_feature: Useful for making plants with altered lignin content
MSNHHTVVYVNGLVRPVLAEAEYSMRTESPADNAIDIYDGDTTENEEEDPLISSAECRICQDECDIKNLESPCACNGSLKYAHRKCVQRWCNEKGNTICEICHQPYQAGYTSPPPPPQSEETTIDIGGGWRISGLDLDDPRLLAIAEAERQILESEYDDYTASDTSGAAFFRSAALILMTLLLLRHALTIPDYSDSEDDDPSSILSLFLLRAASFLLPCYIMASAISILHRRRQRQEAADLATRFALVLSSRQPRPVINYLSMEP

SEQ ID NO: 51158 - protein, 573 aa, Arabidopsis thaliana
  misc_feature: Useful for making plants with altered cell wall content and/or composition
MVTWVLNYLLVAFLFAISYNIDAASAGITRHYQFDIQLKNITRLCKTKTIVTVNGKFPGPRVTAREGDNLQIKVVNHVSNNISIHWHGIRQLRSGWADGPSYVTQCPIRMGQSYVYNFTVTGQRGTLWWHAHIQWMRATVYGPLIILPKLHQPYPFPKPYKQVPILFGEWFNADPQAVVQQALQTGAGPNASDAHTFNGLPGPLYNCSTKDTYKLMVKPGKTYLLRLINAALNDELFFTIANHTLTVVEADACYVKPFQTNIVLLGPGQTTNVLLKTKPIYPNATFYMLARPYFTGQGTIDNTTVAGILQYQHHTKSSKNLSIIKPSLPPINSTSYAANFTKMFRSLASSTFPANVPKVVDKQYFFAIGLGTNPCPKNQTCQGPTNTTKFAASINNVSFILPNKTSLLQSYFVGKSKNVFMTDFPTAPIIPFNYTGTPPNNTMVSRGTKVVVLKYKTTVELVLQGTSILGIEAHPIHLHGFNFYVVGQGFGNFNPARDPKHYNLVDPVERNTINIPSGGWVAIRFLADNPGVWLMHCHIEIHLSWGLTMAWVVLDGDLPNQKLLPPPSDFPKC

SEQ ID NO: 51159 - protein, 375 aa, Glycine max; identical to SEQ ID NO: 9639
  misc_feature: Useful for making plants with altered lignin content

SEQ ID NO: 51160 - protein, 387 aa, Arabidopsis thaliana; identical to SEQ ID NO: 9621
  misc_feature: Useful for biocontainment applications
  misc_feature: Useful for making plants with altered alkaloid content
  misc_feature: Useful for making plants with altered lignin content
  misc_feature: Useful for making plants with altered terpenoid content

SEQ ID NO: 51161 - protein, 437 aa, Panicum virgatum; identical to SEQ ID NO: 5122
  misc_feature: Useful for making plants with altered carbohydrate content

SEQ ID NO: 51162 - protein, 410 aa, Arabidopsis thaliana
  misc_feature: Useful for making plants with altered cell wall content and/or composition
MATSRAFTLFAFTLSLLTVASTVSGHNITQILSDTPEYSSFNNYLSQTKLADEINSRTTITVLVLNNGAMSSLAGKHPLSVVKNALSLLVLLDYYDPLKLHQLSKGTTLTTTLYQTTGHALGNLGFVNVTDLKGGKVGFGSAAPGSKLDSSYTKSVKQIPYNISVLEINAPIIAPGILTAPAPSSAGVSNITGLLEKAGCKTFANLLVSSGVIKTFESTVEKGLTVFAPSDEAFKARGVPDLTNLTQAEVVSLLEYHALAEYKPKGSLKTNKDAISTLATNGAGKYDLTTSTSGDEVILHTGVGPSRLADTVVDETPVVIFTVDNVLLPAELFGKSSSPAPAPEPVSAPTPTPAKSPSPVEAPSPTAASPPAPPVDESSPEGAPSDSPTSSENSNAKNAAFHVNAPALFT

SEQ ID NO: 51163 - protein, 225 aa, Zea mays
  misc_feature: Useful for making plants with modulated biomass
MEKEKEKSRARPSRGHWRPGEDDKLRQLVDKYGPRNWNSIAESLEGRSGKSCRLRWFNQLDPRINRRPFTVAEEELLLRAHRAHGNRWAIISRLFPGRTDNAVKNHWHVVMARRRRRTLVGEAAAIGSVVVPPRHQYFHFGSCSPPPPTRSLCFAVPAGFGPLGLSRPAASCGVRNCNVPTAVALLDDGHRHDMSKDLGGDDDNGGDALAKRKDVQFFDFLGVGI

SEQ ID NO: 51164 - protein, 524 aa, Arabidopsis thaliana
  misc_feature: Useful for making plants with altered lutein content
  misc_feature: Useful for making plants with altered lycopene content
MECVGARNFAAMAVSTFPSWSCRRKFPVVKRYSYRNIRFGLCSARASGGGSSGSESCVAVREDFADEEDFVKAGGSEILFVQMQQNKDMDEQSKLVDKLPPISIGDGALDLVVIGCGPAGLALAAESAKLGLKVGLIGPDLPFTNNYGVWEDEFNDLGLQKCIEHVWRETIVYLDDDKPITIGRAYGRVSRRLLHEELLRRCVESGVSYLSSKVDSITEASDGLRLVACDDNNVIPCRLATVASGAASGKLLQYEVGGPRVCVQTAYGVEVEVENSPYDPDQMVFMDYRDYTNEKVRSLEAEYPTFLYAMPMTKSRLFFEETCLASKDVMPFDLLKKKLMLRLDTLGIRILKTYEEEWSYIPVGGSLPNTEQKNLAFGAAASMVHPATGYSVVRSLSEAPKYASVIAEILTEETTKQINSNISRQAWDTLWPPERKRQRAFFLFGLALIVQFDTEGIRSFFRTFFRLPKWMWQGFLGSTLTSGDLVLFALYMFVISPNNLRKGLINHLISDPTGATMIKTYLKV

SEQ ID NO: 51165 - protein, 467 aa, Panicum virgatum; identical to SEQ ID NO: 4216
  misc_feature: Useful for making plants with altered carbohydrate content

SEQ ID NO: 51166 - protein, 470 aa, Arabidopsis thaliana
  misc_feature: Useful for making plants with altered cell wall content and/or composition
MKLLSNSLMFLPLLALALTAVSSLKYSRNDFPPGFVFGSGTSAYQVEGAADEDGRTPSIWDVFAHAGHSGVAAGNVACDQYHKYKEDVKLMADMGLEAYRFSISWSRLLPSGRGPINPKGLQYYNNLIDELITHGIQPHVTLHHFDLPQALEDEYGGWLSQEIVRDFTAYADTCFKEFGDRVSHWTTINEVNVFALGGYDQGITPPARCSPPFGLNCTKGNSSIEPYIAVHNMLLAHASATILYKQQYKATARVNDFYIGWILHPLVFGDYPETMKTNVGSRLPAFTEEESEQVKGAFDFVGVINYMALYVKDNSSSLKPNLQDFNTDIAVEMTLVGNTSIENEYANTPWSLQQILLYVKETYGNPPVYILENGQMTPHSSSLVDTTRVKYLSSYIKAVLHSLRKGSDVKGYFQWSLMDVFELFGGYERSFGLLYVDFKDPSLKRSPKLSAHWYSSFLKGTLHHPSYASS

SEQ ID NO: 51167 - protein, 500 aa, Arabidopsis thaliana
  misc_feature: Useful for making plants with modulated biomass
MPVDLDNSSTVSGDASVSSTGNQNLTPKSVGKKKRNLPGMPDPDAEVIALSPKTLMATNRFVCEICNKGFQRDQNLQLHRRGHNLPWKLRQRSTKEVRKKVYVCPVSGCVHHDPSRALGDLTGIKKHFCRKHGEKKWKCEKCSKKYAVQSDWKAHSKICGTKEYKCDCGTLFSRRDSFITHRAFCDALAEESAKNHTQSKKLYPETVTRKNPEIEQKSPAAVESSPSLPPSSPPSVAIAPAPAISVETESVKIISSSVLPIQNSPESQENNNHPEVIIEEASRTIGFNVSSSDLSNDHSNNNGGYAGLFVSSTASPSLYASSTASPSLFAPSSSMEPISLCLSTNPSLFGPTIRDPPHFLTPLPPQPAMSATALLQKAAQMGSTGSGGSLLRGLGIVSTTSSSMELSNHDALSLAPGLGLGLPCSSGGSGSGLKELMMGNSSVFGPKQTTLDFLGLGRAVGNGGNTGGGLSALLTSIGGGGGIDLFGSGEFSGKDIGRSS

SEQ ID NO: 51168 - protein, 433 aa, Zea mays; identical to SEQ ID NO: 9590
  misc_feature: Useful for making plants with modulated biomass

SEQ ID NO: 51169 - protein, 436 aa, Oryza sativa
  misc_feature: Useful for biocontainment applications
MVLDLNVESPGGSAATSSSSTPPPPPDGGGGGYFRFDLLGGSPDEDGCSSPVMTRQLFPSPSAVVALAGDGSSTPPLTMPMPAAAGEGPWPRRAADLGVAQSQRSPAGGKKSRRGPRSRSSQYRGVTFYRRTGRWESHIWDCGKQVYLGGFDTAHAAARAYDRAAIKFRGLDADINFNLNDYEDDLKQMRNWTKEEFVHILRRQSTGFARGSSKYRGVTLHKCGRWEARMGQLLGKKYIYLGLFDSEIEAARAYDRAAIRFNGREAVTNFDPSSYDGDVLPETDNEVVDGDIIDLNLRISQPNVHELKSDGTLTGFQLNCDSPEASSSVVTQPISPQWPVLPQGTSMSQHPHLYASPCPGFFVNLREVPMEKRPELGPQSFPTSWSWQMQGSPLPLLPTAASSGFSTGTVADAARSPSSRPHPFPGHHQFYFPPTA

SEQ ID NO: 51170 - protein, 496 aa, Arabidopsis thaliana
  misc_feature: Useful for making plants with modulated nitrogen use efficiency
MEASTFILLLVLVLLLVSAGKHVIYSCRNSTPKTYPVIGCLISFYTNRNRLLDWYTELLTESPSRTVVIRRLAARRTVVTANPSNVEYILKTNFDNYPKGKPFTEILGDFLGNGIFNVDGNLWLKQRRLATHDFTPKSLREYVTVLRNEVEKELLAFLNAAAEDSQPFDLQELLRRFTFNIVCIVFLGIDRCTLNPSSPVSEFDRAFQTASAVSAGRGSAPLSFVWKFKRLVGFGSEKELRKAVGEVHNCVDEIIRDKKRKPANQDFLSRLIVAGESDETVRDMVISIIMAGRDTTSAVATRLFWLITGHEETEHDLVSEIRSVKEEITGGFDYESLKKLSLLKACLCEVMRLYPPVPWDSKHALTDDRLPDGTLVRAGDRVTYFPYGMGRMEELWGEDWDEFKPNRWAESYDKTCCRVLKKVNPFKFPVFQAGPRVCLGEEMAYVQMKYIVASILDRFEIEPIPTDKPDFVPMLTAHMAGGMQVRVHRRDPSLSP

SEQ ID NO: 51171 - protein, 349 aa, Panicum virgatum; identical to SEQ ID NO: 5288
  misc_feature: Useful for making plants with altered carbohydrate content

SEQ ID NO: 51172 - protein, 717 aa, Arabidopsis thaliana
  misc_feature: Useful for making plants with altered cell wall content and/or composition
MDQIEAMLCGGGEKTKVAVTTKTLADPLNWGLAADQMKGSHLDEVKKMVEEYRRPVVNLGGETLTIGQVAAISTVGGSVKVELAETSRAGVKASSDWVMESMNKGTDSYGVTTGFGATSHRRTKNGTALQTELIRFLNAGIFGNTKETCHTLPQSATRAAMLVRVNTLLQGYSGIRFEILEAITSLLNHNISPSLPLRGTITASGDLVPLSYIAGLLTGRPNSKATGPDGESLTAKEAFEKAGISTGFFDLQPKEGLALVNGTAVGSGMASMVLFEANVQAVLAEVLSAIFAEVMSGKPEFTDHLTHRLKHHPGQIEAAAIMEHILDGSSYMKLAQKVHEMDPLQKPKQDRYALRTSPQWLGPQIEVIRQATKSIEREINSVNDNPLIDVSRNKAIHGGNFQGTPIGVSMDNTRLAIAAIGKLMFAQFSELVNDFYNNGLPSNLTASSNPSLDYGFKGAEIAMASYCSELQYLANPVTSHVQSAEQHNQDVNSLGLISSRKTSEAVDILKLMSTTFLVGICQAVDLRHLEENLRQTVKNTVSQVAKKVLTTGINGELHPSRFCEKDLLKVVDREQVFTYVDDPCSATYPLMQRLRQVIVDHALSNGETEKNAVTSIFQKIGAFEEELKAVLPKEVEAARAAYGNGTAPIPNRIKECRSYPLYRFVREELGTKLLTGEKVVSPGEEFDKVFTAMCEGKLIDPLMDCLKEWNGAPIPIC

SEQ ID NO: 51173 - protein, 325 aa, Arabidopsis thaliana
  misc_feature: Useful for making plants with altered cell wall content and/or composition
MECYEQSRQRAAFVVLLFIVMLGSQAQAQLRTDFYSDSCPSLLPTVRRVVQREVAKERRIAASLLRLFFHDCFVNGCDASILLDDTRSFLGEKTAGPNNNSVRGYEVIDAIKSRVERLCPGVVSCADILAITARDSVLLMGGRGWSVKLGRRDSITASFSTANSGVLPPPTSTLDNLINLFRANGLSPRDMVALSGAHTIGQARCVTFRSRIYNSTNIDLSFALSRRRSCPAATGSGDNNAAILDLRTPEKFDGSYFMQLVNHRGLLTSDQVLFNGGSTDSIVVSYSRSVQAFYRDFVAAMIKMGDISPLTGSNGQIRRSCRRPN

SEQ ID NO: 51174 - protein, 320 aa, Panicum virgatum; identical to SEQ ID NO: 4380
  misc_feature: Useful for making plants with altered carbohydrate content

SEQ ID NO: 51175 - protein, 621 aa, Arabidopsis thaliana
  misc_feature: Useful for making plants with altered cell wall content and/or composition
MGSKHNPPGNNRSRSTLSLLVVVGLCCFFYLLGAWQKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 51176 - protein, 485 aa, Panicum virgatum; identical to SEQ ID NO: 4788
  misc_feature: Useful for making plants with altered carbohydrate content

SEQ ID NO: 51177 - protein, 476 aa, Arabidopsis thaliana
  misc_feature: Useful for making plants with altered cell wall content and/or composition
MARRLFLLLLAVTAGLSLTGTTVRAVGINWGTEASHPLPPSKVVELLKSNGIVKVKLFDADPKVLRALSGSNIGVTIGIQNSMLKSLNASVKVAESWVHDNVTRYFNGGNRVRIEYVAVGEEPFLQSYGNQYKPFVIGAAMNIQNALVKANLANEVKVVVPSSFDSFLSESGRPSSGHFRADLNKTMIELLSFLTKHHSPFFVTISPFLSFHQNKNISLDFSLFKETAKAHKDGRKTYRNSFDLSYDTLVSALFTIGFSEVDIVVSKIGWPTDGAENATSLTAEAFFKGLIVHLEKKTASLPRPPVETYIESLLDEDQRNLSAGNFERHWGVFTFDGQAKYNFSFNHKNQVNAQNVQYLPPKWCVVNNNKDLSNASARALEACAVADCTSILPGGSCSGIRWPGNVSYAFNSLYQQNDHSAESCNFGGLGLITTVDPSEDNCRFSIQLDTSHSSSQTPNFFQSWPLLLLFLLSGLF

SEQ ID NO: 51178 - protein, 460 aa, Arabidopsis thaliana
  misc_feature: Useful for making plants with altered cell wall content and/or composition
MAVFVLSLLILSSFSAIPFTYADSGMIGVNYGRIADNLPAPEKVVELLKTQGINRIKLYDTETTVLTALANSGIKVVVSLPNENLASAAADQSYTDTWVQDNIKKYIPATDIEAIAVGNEVFVDPRNTTTYLVPAMKNVQSSLVKFNLDKSIKISSPIALSALASSYPPSAGSFKPELIEPVIKPMLDLLRKTSSHLMVNAYPFFAYAANADKISLDYALFKENAGNVDSGNGLKYNSLLDAQIDAVFAAMSAVGFNDVKLVVTETGWPSAGDENEIGAGSANAAAYNGGLVKRVLTGNGTPLKPKEPLNVYLFALFNENQKTGPTSERNYGLFYPNENKVYDVSLNGKSTPVNDNKEKVVPVKPSLVGQTWCVANGKTTKEKLQEGLDYACGEGGADCRPIQPGATCYNPESLEAHASYAFNSYYQKNARGVGTCNFGGAAYVVSQPPKYGKCEFPTGH

SEQ ID NO: 51179 - protein, 259 aa, Arabidopsis thaliana
  misc_feature: Useful for making plants with modulated low light sensitivity
  misc_feature: Useful for making plants with modulated nitrogen use efficiency
MARDGGVSCLRRSEMMSVGGIGGIESAPLDLDEVHVLAVDDSLVDRIVIERLLRITSCKVTAVDSGWRALEFLGLDNEKASAEFDRLKVDLIITDYCMPGMTGYELLKKIKESSNFREVPVVIMSSENVLTRIDRCLEEGAQDFLLKPVKLADVKRLRSHLTKDVKLSNGNKRKLPEDSSSVNSSLPPPSPPLTISPESSPPLTVSTESSDSSPPLSPVEIFSTSPLSSPIDDEDDDVLTSSSEESPIRRQKMRSPGLD

SEQ ID NO: 51180 - protein, 190 aa, Brassica napus
  misc_feature: Useful for making plants with altered carotene content
  misc_feature: Useful for making plants with altered lignin content
  misc_feature: Useful for making plants with altered terpenoid content
MAEVMLPMKMEMANDPSKFTSPDLLHVLAVDDSHVDRKFIERLLKVSSCKVTVVDSATRALQYLGLDVNEKPIGCKDLKVNLIMTDYSMPGMTGYELLKKIKESSAFRDVPVVVMSSENILSRIDRCLEEGAEDFLLKPVKLSDVRRIRDSLIKVEDLSFTKSINKRELETENVYSLDSSVPLQLKRTKI

SEQ ID NO: 51181 - protein, 481 aa, Arabidopsis thaliana
  misc_feature: Useful for making plants with altered cell wall content and/or composition
MSNLLALVVGFVIVIGHLGILVNGLGVNWGTMATHKLPPKTVVQMLKDNNINKVKLFDADETTMGALAGSGLEVMVAIPNDQLKVMTSYDRAKDWVRKNVTRYNFDGGVNITFVAVGNEPFLKSYNGSFINLTFPALANIQNALNEAGLGNSVKATVPLNADVYDSPASNPVPSAGRFRPDIIGQMTQIVDFLGKNNAPITINIYPFLSLYGNDDFPLNYAFFDGAEPINDNGIDYTNVFDANFDTLVSSLKAVGHGDMPIIVGEVGWPTEGDKHANAGSAYRFYNGLLPRLGTNKGTPLRPTYIEVYLFGLLDEDAKSIAPGPFERHWGIFKFDGQPKFPIDLSGQGQSKFLIGAQNVPYLPNKWCTFNPEAKDLTKLAANIDYACTFSDCTALGYGSSCNTLDANGNASYAFNMFFQVKNQDESACYFQGLATITTQNISQGQCNFPIQIVASSASSFSCSSYSLVVLIVWFLLSGMMF

SEQ ID NO: 51182 - protein, 485 aa, Panicum virgatum; identical to SEQ ID NO: 3236
  misc_feature: Useful for making plants with altered carbohydrate content

SEQ ID NO: 51183 - protein, 521 aa, Arabidopsis thaliana
  misc_feature: Useful for making plants with modulated nitrogen use efficiency
MENDMEEKFEDWKGKEAIPGKHGGIRAASIVCVVVMMENIVFIANGFNFVKYFMGSMHYTPATAANMVTNFMGTSFLLTLFGGFIADSFVTHFTTFIVFCCIELMGLILLTFQAHNPKLLPEKDKTPSTLQSAILFTGLYAMAIGTGGLKASLPSHGGDQIDRRNPRLISRFFDWLYFSICSGCLLAVTVVLWIEEKKGWIWSFNISVGILATALCIFTVGLPFYRFKRPNGSPLKKIAIVIISAARNRNKSDLDEEMMRGLISIYKNNSHNKLKWIDKATLNKNISETEVEETRTFLGLLPIFGSTIVMSCCVAQLSTFSAQQGMLMNKKLFHSFEIPVPSLTAIPLIFMLLSIPLYEFFGKKISSGNNNRSSSFNLKRIGLGLALSSVSMAVSAIVEAKRKHEVVHNNFRISVLWLVFQYLMLSVSDMLTLGGMLEFFYREAPSNMKSISTALGWCSTALGFFLSTTLVEVTNAVTGRLGHQWLGGEDLNKTRLELFYVLLCVLNTLNLLNYIFWAKRY

SEQ ID NO: 51184 - protein, 288 aa, Arabidopsis thaliana
  misc_feature: Useful for making plants with altered cell wall content and/or composition
MAMTSTMQLLVLSFLVIASLFLGATVAPPASLISTPDQALKDKADLIVAKDGSGNFTTVNEAVAAAPENGVKPFVIYIKEGLYKEVIRIGKKKTNLTLVGDGRDLTVLSGDLNGVDGIKTFDSATLAVDESGFMAQDLCIRNTAGPEKRQAVALRISTDMTIIYRCRIDAYQDTLYAYSGRQFYRDCYITGTVDFIFGRAAAVFQYCQIEARKPGIGQTNILTAQSREEDTATSGFSFQKCNISASSDLTPIKGTVKTFLGRPWRAFSRVVFMESFIDDVIDRAGWTP

SEQ ID NO: 51185 - protein, 511 aa, Arabidopsis thaliana
  misc_feature: Useful for making plants with altered cell wall content and/or composition
MMAFRAYIINFVILCILVASTVSGYNQKDVKAWCSQTPNPKPCEYFLTHNSNNEPIKSESEFLKISMKLVLDRAILAKTHAFTLGPKCRDTREKAAWEDCIKLYDLTVSKINETMDPNVKCSKLDAQTWLSTALTNLDTCRAGFLELGVTDIVLPLMSNNVSNLLCNTLAINKVPFNYTPPEKDGFPSWVKPGDRKLLQSSTPKDNAVVAKDGSGNFKTIKEAIDAASGSGRFVIYVKQGVYSENLEIRKKNVMLRGDGIGKTIITGSKSVGGGTTTFNSATVAAVGDGFIARGITFRNTAGASNEQAVALRSGSDLSVFYQCSFEAYQDTLYVHSNRQFYRDCDVYGTVDFIFGNAAAVLQNCNIFARRPRSKTNTITAQGRSDPNQNTGIIIHNSRVTAASDLRPVLGSTKTYLGRPWRQYSRTVFMKTSLDSLIDPRGWLEWDGNFALKTLFYAEFQNTGPGASTSGRVTWPGFRVLGSASEASKFTVGTFLAGGSWIPSSVPFTSGL

SEQ ID NO: 51186 - protein, 622 aa, Arabidopsis thaliana
  misc_feature: Useful for making plants with altered cell wall content and/or composition
MELFALLIKVAGLLATVTVGANVVSYSRFRRQNLAKFRSPIDESKEVLADFNSIEHEEGKFFFGLATAPAHAEDDLDDAWLQFAKETPCSAEEAEAADKKARRKKVKLAVGAITKGLAKNTHGKEDKNAADKPPSKNVAAWHNAPHAEDRLKFWSDPDKEVKLAKDTGVTVFRMGVDWSRIMPVEPTKGIKEAVNYEAVEHYKWILKKVRSNGMKVMLTLFHHSLPPWAADYGGWKMEKTVDYFMDFTRIVVDSMYDLVDSWVTFNEPHIFTMLTYMCGSWPGNNPDFLEIATSTLPMGVFHRALHWMAVAHSKAYDYIHGKISLKKPLVGVAHHVSFMRPYGLFDIGAVTISNSLTIFPYIDSICEKLDFIGINYYGQEAVCGAGLKLVETDEYSESGRGVYPDGLYRVLLMFHERYKHLKVPFIVTENGVSDETDVIRRPYLIEHLLALYAAMLKGVPVLGYIFWTISDNWEWADGYGPKFGLVAVDRSHDLARTLRQSYHLFSKIVKSGKVTRKDRSLAWNELQKAAKAGKLRPFYRGVDNHNLMYADGLDKPQWRPFVDRDWRFGHYQMDGLQDPLSRVARTLLIWPLIMKKRIRKVKIKHTDDAGLVLHPALASPFD

SEQ ID NO: 51187 - protein, 496 aa, Arabidopsis thaliana; identical to SEQ ID NO: 9476
  misc_feature: Useful for making plants with modulated nitrogen use efficiency

SEQ ID NO: 51188 - protein, 586 aa, Arabidopsis thaliana
  misc_feature: Useful for making plants with altered cell wall content and/or composition
MPRVHHSLSNQAFLVLLLFSSIASAAIVEHVLHVKDVVVTPLCKEQMIPIVNGSLPGPTINVREGDTLVVHVINKSTYNVTIHWHGVFQLKSVWMDGANMITQCPIQPSNNFTYQFDITGQEGTLLWHAHVVNLRATIHGALIIRPRSGRPYPFPKPYKEVPLIFQQWWDTDVRLLELRPAPVSDAYLINGLAGDSYPCSKNRMFNLKVVQGKTYLLRIINAALNTHLFFKIANHNVTVVAVDAVYTTPYLTDVMILTPGQTIDAILTADQPIGTYYMAIIPYFSAIGVPASPDTKPTRGLIVYEGATSSSSPTKPWMPPANDIPTAHRFSSNITSLVGGPHWTPVPRHVDEKMFITMGLGLDPCPSNAKCVGPLDQRLAGSLNNRTFMIPERISMQEAYFYNITGVYTDDFPDQPPLKFDFTKFEQHPTNSDMEMMFPERKTSVKTIRFNSTVEIVLQNTGILTPESHPMHLHGFNFYVLGYGFGNYDPIRDARKLNLFNPQMHNTVGVPPGGWVVLRFIANNPGIWLFHCHMDAHLPLGIMMAFIVQNGPTRETSLPSPPSNLPQCTRDPTIYDSRTTNVDMSY

SEQ ID NO: 51189 - protein, 457 aa, Panicum virgatum; identical to SEQ ID NO: 4176
  misc_feature: Useful for making plants with altered carbohydrate content

SEQ ID NO: 51190 - protein, 374 aa, Arabidopsis thaliana
  misc_feature: Useful for making plants with altered cell wall content and/or composition
MGDEAEIKEHLKPQASSETIDKKHNVKGKRLWQKVKYQLVEFHSLPAYLRDNEYIIGHYRSEWPIKQILLSIFTIHNETLNVWTHLIGFFLFLALTIYTATKVPSVVDLHSLQHRLPDLLRKTDLHKLHSELMSRLPSSPSSWHVMDLLYNCLPERFSHGNYTDMCVLHSVREDLANLIAPLIFRPITRWPFYAFLGGAIFCLLASSTCHLLSCHSERVSYIMLRLDYAGIAALIATSFYPPVYYSFMCDPFFCNLYLGFITILGIATVLVSLLPVFQSLEFRVVRASLFFGMGFSGLAPILHKLIIFWDQPEALHMTGYEILMGLLYGLGAVVYATRIPERWMPGKFDIAGHSHQLFHVLVVAGALTHYRAGL

SEQ ID NO: 51191 - protein, 657 aa, Arabidopsis thaliana
  misc_feature: Useful for making plants with modulated water use efficiency
MTIITIISGMYIYSLLSQDAHHSQYGQNTNLVLKKPIPKPQTAAFNQESTMASTTLLPSTSTQFLDRTFSTSSSSSRPKLQSLSFSSTLRNKKLVVPCYVSSSVNKKSSVSSSLQSPTFKPPSWKKLCNDVTNLIPKTTNQNPKLNPVQRTAAMVLDAVENAMISHERRRHPHPKTADPAVQIAGNFFPVPEKPVVHNLPVTGTVPECIQGVYVRNGANPLHKPVSGHHLFDGDGMVHAVRFDNGSVSYACRFTETNRLVQERECGRPVFPKAIGELHGHLGIAKLMLFNTRGLFGLVDPTGGLGVANAGLVYFNGHLLAMSEDDLPYHVKVTQTGDLETSGRYDFDGQLKSTMIAHPKIDPETRELFALSYDVVSKPYLKYFRFTSDGEKSPDVEIPLDQPTMIHDFAITENFVVIPDQQVVFRLPEMIRGGSPVVYDEKKKSRFGILNKNAKDASSIQWIEVPDCFCFHLWNSWEEPETDEVVVIGSCMTPPDSIFNEHDETLQSVLSEIRLNLKTGESTRRPVISEQVNLEAGMVNRNLLGRKTRYAYLALTEPWPKVSGFAKVDLSTGEIRKYIYGEGKYGGEPLFLPSGDGEEDGGYIMVFVHDEEKVKSELQLINAVNMKLEATVTLPSRVPYGFHGTFISKEDLSKQALC

SEQ ID NO: 51192 - protein, 382 aa, Arabidopsis thaliana
  misc_feature: Useful for making plants with altered lignin content
MPINDQFPSGLRILVVDDDTSCLFILEKMLLRLMYQVTICSQADVALTILRERKDSFDLVLSDVHMPGMNGYNLLQQVGLLEMDLPVIMMSVDGRTTTVMTGINHGACDYLIKPIRPEELKNIWQHVVRRKCVMKKELRSSQALEDNKNSGSLETVVVSVSECSEESLMKCRNKKKKKKRSVDRDDNEDDLLLDPGNSKKSRVVWSIELHQQFVNAVNKLGIDKAVPKRILELMNVPGLSRENVASHLQKFRLYLKRLSGEASQSNDSESTKRYENIQALVSSGQLHPQTLAALFGQPIDNHHSASFGVWIPNDNLGRSQNEHFSVDVSSASNRPVSVAVHGLSSSANFRQRGNVNNNRIRQGYGSNVNEESWILERSSRQR

SEQ ID NO: 51193 - protein, 501 aa, Panicum virgatum; identical to SEQ ID NO: 1800
  misc_feature: Useful for making plants with altered carbohydrate content

SEQ ID NO: 51194 - protein, 220 aa, Arabidopsis thaliana; identical to SEQ ID NO: 9568
  misc_feature: Useful for making plants with altered lignin content

SEQ ID NO: 51195 - protein, 147 aa, Arabidopsis thaliana; identical to SEQ ID NO: 9479
  misc_feature: Useful for making plants with modulated biomass
  misc_feature (140)..(140): Xaa is any aa, unknown, or other

SEQ ID NO: 51196 - protein, 505 aa, Arabidopsis thaliana; identical to SEQ ID NO: 9723
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time

SEQ ID NO: 51197 - protein, 586 aa, Zea mays
  misc_feature: Useful for making plants with modulated water use efficiency
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHSSYLTGNQLNSDSSDVPIVKALQGGVRVIELDMWPNPSKDNVDILHGGTLTAPVEMIKCLKSIKEYAFCASNYPLVITLEDHLTPDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLSVKKTLKVKVYMGDRWRMDFSKTHFDAFSPPDFYTKVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 51198 - protein, 217 aa, Arabidopsis thaliana; identical to SEQ ID NO: 9611
  misc_feature: Useful for making plants with altered alkaloid content
  misc_feature: Useful for making plants with altered terpenoid content

SEQ ID NO: 51199 - protein, 163 aa, Arabidopsis thaliana
  misc_feature: Useful for making plants with modulated water use efficiency
MAMVSGRRSTLNPDAPLFIPAAVRQVEDFSPEWWQLVTTSTWYPDYWISQQQQGADGFYDNGENENGGGHIDVADLLPESFDFDDMEDFFDTDAAEFDQGFDGRMYYQAPSEFGFGKNGEMVKKSSGNRSPRSIVEPAKYAEKPAKWGNQRVAAAPRNIHQPR

SEQ ID NO: 51200 - protein, 69 aa, Arabidopsis thaliana; identical to SEQ ID NO: 9351
  misc_feature: Useful for making plants with modulated flowering time

SEQ ID NO: 51201 - protein, 598 aa, Arabidopsis thaliana
  misc_feature: Useful for making plants with modulated biomass
METGNVVNAQPELSGIIDRSKSYMYEQLWKLCAGPLCDIPKLGEKVYYFPQGNIELVEASTREELNELQPICDLPSKLQCRVIAIHLKVENNSDETYAKITLMPDTTVSENLQVVIPTQNENQFRPLVNSFTKVLTASDISANGVFSVPKKHAIECLPPLDMSQPLPAQELLAIDLHGNQWSFRHSYRGTPQRHLLTTGWNEFTTSKKLVKGDVIVFVRGETGELRVGIRRARHQQGNIPSSIVSIDCMRHGVIASAKHAFDNQCMFIVVYKPRSSQFIVSYDKFLDAVNNKFNVGSRFTMRFEGDDLSERRYFGTIIGVSNFSPHWKCSDWRSLEVQWDEFASFLRPNKVSPWEIEHLMPALNVPRSSFLKNKRLREVNEFGSSSSHLLPPILTQGQEIGQLSVASPMNISLLYRETTEDAMNPSRLLMSYPVQPMPKRNYNNQMVTQIEENITTKAGTNFRLFGVSLATPPVIKDPIEQIGSDISKLTEGKKFGQSQTLRSPTKIQSKQFSSTRTCTKVQMQGVTIGRAVDLSVLNGYDQLILELEKLFDLKGQLQTRNQWKIIFTGSDEDEMLVGDDPWPEFCNMVKRIYIQKRR

SEQ ID NO: 51202 - protein, 103 aa, Arabidopsis thaliana
  misc_feature: Useful for making plants with altered cell wall content and/or composition
MVIHKSITPIALMLLLLLAIHAHIQVVGSTTVTSVSLANLKHETSSEINFPVWRRELRGGGGGGRGGGGGHGGGGGEDFGNGCRSDVLQSFLFMVFISYWLLV

SEQ ID NO: 51203 - protein, 442 aa, Panicum virgatum; identical to SEQ ID NO: 7480
  misc_feature: Useful for making plants with altered carbohydrate content

SEQ ID NO: 51204 - protein, 144 aa, Arabidopsis thaliana
  misc_feature: Useful for making plants with altered lignin content
  misc_feature: Useful for making plants with altered terpenoid content
  misc_feature: Useful for making plants with modulated salt sensitivity
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 51205 - protein, 990 aa, Arabidopsis thaliana
  misc_feature: Useful for making plants with modulated biomass
MEEKTHHHHHSTNKHIPSSKSRTPLLHKPYHHHVQTNPPPFLLHPSSHQNLNLVASNLPSSYYYYYYCYFYSQFHNSLPPPPPPHLLPLSPPLPPLLPLPPPHSMTRFHKSLPVSQVVERKQQHQQKKKIQVSNNKVSGSIAIEEAALVVAKRPDFGGQDGSVIYLLANHFLVKFDSSQRIYHYNVEISPQPSKEIARMIKQKLVETDRNSFSGVVPAFDGRQNIYSPVEFQGDRLEFFVNLPIPSCKAVMNYGDLREKQPQKKIEKLFRVNMKLVSKFDGKEQRKEGEDWAPLPPEYIHALDVILRENPMEKCTSIGRSFYSSSMGGSKEIGGGAVGLRGFFQSLRHTQQGLALNMDLSITAFHESIGVIAYLQKRLEFLTDLPRNKGRELSLEEKREVEKALKNIRVFVCHRETVQRYRVYGLTEEITENIWFPDREGKYLRLMSYFKDHYGYEIQFKNLPCLQISRARPCYLPMELCMICEGQKFLGKLSDDQAAKIMKMGCQKPNERKAIIDKVMTGSVGPSSGNQTREFNLEVSREMTLLKGRILQPPKLKLDRPRNLKESKVFKGTRIERWALMSIGGSSDQKSTIPKFINELTQKCEHLGVFLSKNTLSSTFFEPSHILNNISLLESKLKEIQRAASNNLQLIICVMEKKHKGYGDLKRISETRIGVVTQCCLYPNITKLSSQFVSNLALKINAKIGGSMTELYNSIPSHIPRLLRPDEPVIFMGADVTHPHPFDDCSPSVAAVVGSINWPEANRYVSRMRSQTHRQEIIQDLDLMVKELLDDFYKAVKKLPNRIIFFRDGVSETQFKKVLQEELQSIKTACSKFQDYNPSITFAVVQKRHHTRLFRCDPDHENIPPGTVVDTVITHPKEFDFYLCSHLGVKGTSRPTHYHILWDENEFTSDELQRLVYNLCYTFVRCTKPISIVPPAYYAHLAAYRGRLYIERSSESNGGSMNPSSVSRVGPPKTIPLPKLSDNVKNLMFYC

SEQ ID NO: 51206 - protein, 139 aa, Arabidopsis thaliana; identical to SEQ ID NO: 9696
  misc_feature: Useful for making plants with modulated biomass
  misc_feature: Useful for making plants with modulated flowering time

SEQ ID NO: 51207 - protein, 113 aa, Oryza sativa subsp. indica
  misc_feature: Useful for making plants with modulated biotic stress sensitivity
MADWAMHHYLLLANQQRHRALADVAVRRRQLLLDSGRVFMLLGAVILMHMLTTTGGGASSGCTRGAEPCVALLLWLLGAALAMLSLVAGRFPVLAAAIAEELGDHLLGGLWSL

SEQ ID NO: 51208 - protein, 135 aa, Panicum virgatum; identical to SEQ ID NO: 2270
  misc_feature: Useful for biocontainment applications

SEQ ID NO: 51209 - protein, 272 aa, Arabidopsis thaliana
  misc_feature: Useful for biocontainment applications
  misc_feature: Useful for making plants with modulated biomass
MAQQHSFLLLCFFLSISYLLSSAQTEATSIERLVPRDLYNKIFIHKDNTACPANGFYTYESFVQATRRFPRFGSVGSPVTQRLEVAAFLAQISHETTGGWATAPDGPYAWGLCFKEEVSPQSTYCDSSNTQWPCFPNKTYQGRGPIQLSWNYNYGPAGRALGFDGLRNPETVSNNSVIAFQTALWFWMTPQSPKPSCHDVMIGKYRPTAADLAANRTGGFGLTTNIINGGLECGIPGDGRVNDRIGFFQRYTGLFKVATGPNLDCENQRPYA

SEQ ID NO: 51210 - protein, 1045 aa, Arabidopsis thaliana
  misc_feature: Useful for making plants with altered cell wall content and/or composition
MATKAEEQYVSNSLFTGGFNSVTRAHLMDKVIDSDVTHPQMAGAKGSSCAMPACDGNVMKDERGKDVMPCECRFKICRDCFMDAQKETGLCPGCKEQYKIGDLDDDTPDYSSGALPLPAPGKDQRGNNNNMSMMKRNQNGEFDHNRWLFETQGTYGYGNAYWPQDEMYGDDMDEGMRGGMVETADKPWRPLSRRIPIPAAIISPYRLLIVIRFVVLCFFLTWRIRNPNEDAIWLWLMSIICELWFGFSWILDQIPKLCPINRSTDLEVLRDKFDMPSPSNPTGRSDLPGIDLFVSTADPEKEPPLVTANTILSILAVDYPVEKVSCYLSDDGGALLSFEAMAEAASFADLWVPFCRKHNIEPRNPDSYFSLKIDPTKNKSRIDFVKDRRKIKREYDEFKVRINGLPDSIRRRSDAFNAREEMKALKQMRESGGDPTEPVKVPKATWMADGTHWPGTWAASTREHSKGDHAGILQVMLKPPSSDPLIGNSDDKVIDFSDTDTRLPMFVYVSREKRPGYDHNKKAGAMNALVRASAILSNGPFILNLDCDHYIYNCKAVREGMCFMMDRGGEDICYIQFPQRFEGIDPSDRYANNNTVFFDGNMRALDGVQGPVYVGTGTMFRRFALYGFDPPNPDKLLEKKESETEALTTSDFDPDLDVTQLPKRFGNSTLLAESIPIAEFQGRPLADHPAVKYGRPPGALRVPRDPLDATTVAESVSVISCWYEDKTEWGDRVGWIYGSVTEDVVTGYRMHNRGWRSVYCITKRDSFRGSAPINLTDRLHQVLRWATGSVEIFFSRNNAILASKRLKFLQRLAYLNVGIYPFTSLFLILYCFLPAFSLFSGQFIVRTLSISFLVYLLMITICLIGLAVLEVKWSGIGLEEWWRNEQWWLISGTSSHLYAVVQGVLKVIAGIEISFTLTTKSGGDDNEDIYADLYIVKWSSLMIPPIVIAMVNIIAIVVAFIRTIYQAVPQWSKLIGGAFFSFWVLAHLYPFAKGLMGRRGKTPTIVFVWAGLIAITISLLWTAINPNTGPAAAAEGVGGGGFQFP

SEQ ID NO: 51211 - protein, 640 aa, Glycine max
  misc_feature: Useful for making plants with altered alkaloid content
MSKELGDVEESNKPSTSGGYWDTVETENEVGNTTIPSQGHLDTYVLDPSVSHDQLFSIIDYSPSWAFEGSEIKVIISGEFLRSQHEAEQCKWSCMFGEVEVPAVIIAKGVLCCHTPPHKAGRVPFYVTCSNRLACSEVREFDFQVHYTPEDTTGENRGSTFDTFSIRFGELLSLGHAFPQNSDSISVSEKSQLRSKINSLLREDDDDWDKLLKLTQEKDFSPENLREQLLQNLLKDKLHAWLLQKITEEGKGPNVLDEGGQGVLHFAAALGYDWALEPTIVAGVNVNFRDVNGWTSLHWAAFCGRERTVAFLISLGAAPGALTDPCPEHPSGRTPADLASANGHKGIAGYLAESSLSAHLTTLDLNRDAGENSGAKVVQRLQNIAQVNDLDGLSYELSLKDSLAAVCNATQAAARIHQVFRMQSFQRKQLKEYDDDKLGLSDERALSLIKMNVKSHKSGPRDEPVHAAAIRIQNKFRSWKGRREFLMIRQRIVKIQAHVRGHQVRKSCGKIIWSVGILEKVILRWRRKGSGLRGFKPEANSEGTMIQDVSSTDDDYDVLKEGRKQTEQRLQKALARVKSMVQYPEARDQYHRLLNVVTEIQENQVKHESSSNNSEEPREFGDLNDLEALLDEDIFMPTAT

SEQ ID NO: 51212 - protein, 567 aa, Arabidopsis thaliana
  misc_feature: Useful for making plants with altered cell wall content and/or composition
MEGVRVPIACALILLAISSITSASIVEHTFNVQNLTVSRLCKRQVITVVNGSLPGPTIRVKEGDSLVIHVLNHSPHNITIHWHGIFHKLTVWADGPSMITQCPIQPGQRYAYRFNITGQEGTLWWHAHASFLRATVYGALVIRPKSGHSYPFPKPHKEVPILFGEWWNTDVVALEEAAIATGVPPNNSDAYTINGRPGNLYPCSKDRMFSLNVVKGKRYLLRIINAAMNIQLFFKIANHRLTVVAADAVYTAPYVTDVIVIAPGQTIDALLFADQSVDTSYYMAAHPYASAPAVPFPNTTTRGVIHYGGASKTGRSKPVLMPKLPSFFDTLTAYRFYSNLTALVNGPHWVPVPRYVDEEMLVTIGLGLEACADNTTCPKFSASMSNHSFVLPKKLSILEAVFHDVKGIFTADFPDQPPVKFDYTNPNVTQTNPGLLFTQKSTSAKILKFNTTVEVVLQNHALIAAESHPMHLHGFNFHVLAQGFGNYDPSRDRSKLNLVDPQSRNTLAVPVGGWAVIRFTANNPGAWIFHCHIDVHLPFGLGMIFVVKNGPTKSTTLPPPPPDLPKC

SEQ ID NO: 51213 - protein, 268 aa, Arabidopsis thaliana
  misc_feature: Useful for making plants with altered alkaloid content
  misc_feature: Useful for making plants with altered lignin content
MSSRWNRTIYVGNLPGDIRKCEVEDLFYKYGPIVDIDLKIPPRPPGYAFVEFEDPRDADDAIYGRDGYDFDGCRLRVEIAHGGRRFSPSVDRYSSSYSASRAPSRRSDYRVLVTGLPPSASWQDLKDHMRKAGDVCFSEVFPDRKGMSGVVDYSNYDDMKYAIRKLDATEFRNAFSSAYIRVREYESRSVSRSPDDSKSYRSRSRSRGPSCSYSSKSRSVSPARSISPRSRPLSRSRSPYSSVSRSQSRSKSRSRSRSNSPVSPVISG

SEQ ID NO: 51214 - protein, 205 aa, Arabidopsis thaliana; identical to SEQ ID NO: 9647
  misc_feature: Useful for making plants with modulated drought sensitivity
  misc_feature: Useful for making plants with modulated water use efficiency

SEQ ID NO: 51215 - protein, 490 aa, Panicum virgatum; identical to SEQ ID NO: 4890
  misc_feature: Useful for making plants with altered carbohydrate content

SEQ ID NO: 51216 - protein, 582 aa, Arabidopsis thaliana
  misc_feature: Useful for making plants with altered cell wall content and/or composition
MKMHFFILLVITSWLSEKITSLPPDSRVFDRHGFPDNFVFGTAASAFQYEGATSEGGKSPSIWDYFSHTFPERTRMQNADVAVDFYHRYKDDIKLMKELNMDAFRFSISWARLIPSGKVKDGVNKEGVEFYKALIDELVANGIEPSMTLYHWDHPQSLEDEYGGFLSPQIVEDFRDFSRVCFEEFGDKVKMWTTINEPYVITVAGYDTGNKAVGRCSKWVNSKCQGGDSGTEPYIASHHLLLAHAAAVQEFRKCNKTQDGQIGIVLSPLWFEPYDSASPADNEAVKRALATELDWHLDPVIHGDYPEMMKKLAGNRLPSFTPEQSKMLKNSSDFIGINYYTARYVAHIPQADPARPRFVTDHQLQWRVTNHSNHQFGPGEDRGILQSHPEGLRKVLNYIKDKYNNPIVYIKENGINDYDDGTKSREEILNDTFRISYHEDHLQQLQKAIIEDGCDVRGYYVWSLLDNFEWEHGYSTRFGVYYVDYDNDLTRIPKDSVNWFKQFLDVKNKEIWDVSHKERYNKTFDDVESFEASVGSILYLMTNNISRREEEERDQCAFGNLNDQSGLLLESYNSFGFLENVW

SEQ ID NO: 51217 - protein, 534 aa, Arabidopsis thaliana; identical to SEQ ID NO: 9456
  misc_feature: Useful for biocontainment applications
  misc_feature: Useful for making plants with modulated flowering time
  misc_feature: Useful for making plants with modulated nitrogen use efficiency
  misc_feature (497)..(497): Xaa is any aa, unknown, or other

SEQ ID NO: 51218 - protein, 216 aa, Glycine max; identical to SEQ ID NO: 9640
  misc_feature: Useful for making plants with altered lignin content
  misc_feature (123)..(123): Xaa is any aa, unknown, or other

SEQ ID NO: 51219 - protein, 38 aa, Glycine max
  misc_feature: Useful for making plants with modulated heat sensitivity
MNEKEKELNRALKVDVERKDRSIEEMALEADEYRKFVF

SEQ ID NO: 51220 - protein, 130 aa, Arabidopsis thaliana; identical to SEQ ID NO: 9669
  misc_feature: Useful for making plants with altered glycerol content

SEQ ID NO: 51221 - protein, 140 aa, Panicum virgatum; identical to SEQ ID NO: 26648
  misc_feature: Useful for making plants with altered carbohydrate content

SEQ ID NO: 51222 - protein, 631 aa, Arabidopsis thaliana
  misc_feature: Useful for making plants with modulated flowering time
MPGIPLVSRETSSCSRSTEQMCHEDSRLRISEEEEIAAEESLAAYCKPVELYNIIQRRAIRNPLFLQRCLHYKIEAKHKRRIQMTVFLSGAIDAGVQTQKLFPLYILLARLVSPKPVAEYSAVYRFSRACILTGGLGVDGVSQAQANFLLPDMNRLALEAKSGSLAILFISFAGAQNSQFGIDSGKIHSGNIGGHCLWSKIPLQSLYASWQKSPNMDLGQRVDTVSLVEMQPCFIKLKSMSEEKCVSIQVPSNPLTSSSPQQVQVTISAEEVGSTEKSPYSSFSYNDISSSSLLQIIRLRTGNVVFNYRYYNNKLQKTEVTEDFSCPFCLVKCASFKGLRYHLPSTHDLLNFEFWVTEEFQAVNVSLKTETMISKVNEDDVDPKQQTFFFSSKKFRRRRQKSQVRSSRQGPHLGLGCEVLDKTDDAHSVRSEKSRIPPGKHYERIGGAESGQRVPPGTSPADVQSCGDPDYVQSIAGSTMLQFAKTRKISIERSDLRNRSLLQKRQFFHSHRAQPMALEQVLSDRDSEDEVDDDVADFEDRRMLDDFVDVTKDEKQMMHMWNSFVRKQRVLADGHIPWACEAFSRLHGPIMVRTPHLIWCWRVFMVKLWNHGLLDARTMNNCNTFLEQLQI

SEQ ID NO: 51223 - protein, 147 aa, Panicum virgatum; identical to SEQ ID NO: 2
  misc_feature: Useful for biocontainment applications

SEQ ID NO: 51224 - protein, 226 aa, Arabidopsis thaliana
  misc_feature: Useful for making plants with altered alkaloid content
  misc_feature: Useful for making plants with altered lignin content
MSSSDSVNNGVNSRMYFRNPSFSNVILNDNWSDLPLSVDDSQDMAIYNTLRDAVSSAWTPSVPPVTSPAEEDKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGKSSLVVPELDFTVDQFYFDGSLLMDQSECSYSDNRI

SEQ ID NO: 51225 - protein, 268 aa, Arabidopsis thaliana; identical to SEQ ID NO: 9657
  misc_feature: Useful for making plants with altered cell wall content and/or composition
  misc_feature: Useful for making plants with altered lignin content

SEQ ID NO: 51226 - protein, 102 aa, Arabidopsis thaliana; identical to SEQ ID NO: 9279
  misc_feature: Useful for making plants with altered protein content

SEQ ID NO: 51227 - protein, 157 aa, Arabidopsis thaliana
  misc_feature: Useful for making plants with modulated heat sensitivity
  misc_feature (14)..(14): Xaa is any aa, unknown, or other
MSLIPSFFGNNRRXNSIFDPFSLDVWDPFKELQFPSSLSGETSAITNARVDWKETAEAHVFKADLPGMKKEEVKVEIEDDSVLKISGERHVEKEEKQDTWHRVERSSGQFSRKFKLPENVKMDQVKASMENGVLTVTVPKVEEAKKKAQVKSIDISG

SEQ ID NO: 51228 - protein, 234 aa, Arabidopsis thaliana; identical to SEQ ID NO: 9370
  misc_feature: Useful for making plants with altered alkaloid content
  misc_feature: Useful for making plants with altered lignin content

SEQ ID NO: 51229 - protein, 217 aa, Arabidopsis thaliana
  misc_feature: Useful for making plants with altered lignin content
  misc_feature: Useful for making plants with altered terpenoid content
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPNPYMGQPMWQQPGPEQQDPDN

SEQ ID NO: 51230 - protein, 202 aa, Arabidopsis thaliana
  misc_feature: Useful for making plants with modulated cold sensitivity
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 51231 - protein, 132 aa, Arabidopsis thaliana
  misc_feature: Useful for making plants with modulated nitrogen use efficiency
MKQLIRRLSRVADSAQYSLLRSDSQRPSRRSESFLRSSVTRRSKKQTSSVPEGHVPVYVGDEMERFVVSAELLNHPVFIGLLNRSAQEYGYEQKGVLQIPCHVLVFERIMESLRLGLPVPIDVQDLIGDGTI

SEQ ID NO: 51232 - protein, 303 aa, Panicum virgatum; identical to SEQ ID NO: 26948
  misc_feature: Useful for making plants with altered carbohydrate content

SEQ ID NO: 51233 - protein, 68 aa, Arabidopsis thaliana
  misc_feature: Useful for making plants with modulated nitrogen use efficiency
MPSSIRWWWPIHFTSSGSVPRWLSWRRPELSLLSVVVDDVVWKVVTAFESVALVSMLCFFFLFCGCTV

SEQ ID NO: 51234 - protein, 105 aa, Arabidopsis thaliana; identical to SEQ ID NO: 9673
  misc_feature: Useful for biocontainment applications

SEQ ID NO: 51235 - protein, 70 aa, Arabidopsis thaliana
  misc_feature: Useful for making plants with altered cell wall content and/or composition
MGLDWGPVLMSVIFFIVLSPGVLFQLPGKSKAVEFGGFQTSGPSIVIHTLLFFAFITISLIALHIHIYAA

SEQ ID NO: 51236 - protein, 184 aa, Arabidopsis thaliana; identical to SEQ ID NO: 9374
  misc_feature: Useful for making plants with modulated oxidative stress sensitivity

SEQ ID NO: 51237 - protein, 223 aa, Arabidopsis thaliana; identical to SEQ ID NO: 9427
  misc_feature: Useful for making plants with altered sterol content
  misc_feature: Useful for making plants with modulated nitrogen use efficiency

SEQ ID NO: 51238 - protein, 483 aa, Arabidopsis thaliana
  misc_feature: Useful for making plants with altered cell wall content and/or composition
MMLQRSCIVLFFSLFLLVPQMVFSMLNRTLLLIPHPDPELVAYQVQWKVNASITRRQALDTTDQAGSTPCITGNPIDDCWKCDPNWPNNRQGLADCGIGFGQYALGGKGGQFYFVTDSSDDDAVNPKPGTLRYGVIQEEPLWIVFPSNMMIKLKQELIFNSYKTLDGRGANVHIVGGGCITLQYVSNIIIHNIHIHHCYQSGNTNVRSSPTHYGFRTKSDGDGISIFGSKDIWIDHCSLSRCKDGLIDAVMGSTGITISNNFFSHHNEVMLLGHSDHYEPDSGMQVTIAFNHFGEKLIQRMPRCRRGYIHVVNNDFTQWEMYAIGGSGNPTINSQGNRYTAPTNPFAKEVTKRVETPDGDWKGWNWRSEGDILVNGAFFVASGEGAEMRYEKAYSVEPKSASFITQITFHSGVLGVGGRNNNLGMWTTTGSEGTSGLDSYNDYTDEMSGAGSTNRLSFSVLVFLLSSISYLVVFTSSTQMFML

SEQ ID NO: 51239 - protein, 148 aa, Arabidopsis thaliana; identical to SEQ ID NO: 9298
  misc_feature: Useful for making plants with altered alkaloid content
  misc_feature: Useful for making plants with modulated drought sensitivity
  misc_feature: Useful for making plants with modulated heat sensitivity

SEQ ID NO: 51240 - protein, 478 aa, Arabidopsis thaliana
  misc_feature: Useful for making plants with altered cell wall content and/or composition
MNLLAFVVGFGIMGIVMVDGLGVNWGTMATHKLPPKKVVQMLKDNNINKVKLFDADETTMSALSGSGLEVMVAIPNDQLKVMGSYDRAKDWVHKNVTRYNFNGGVNITFVAVGNEPFLKSYNGSFINLTFPALQNIQNALNEAGLGSSVKATVPLNADVYDSPSSNPVPSAGRFRPDIIGQMTQIVDFLGNNSAPITINIYPFLSLYGNDDFPLNYAFFDGAKPVDDNGIAYTNVFDANFDTLVSALKAVGHGDMPIIVGEVGWPTEGDKHANSGSAYRFYNGLLPRLGENRGTPLRPTYIEVYLFGLLDEDAKSIAPGEFERHWGIFKFDGQPKFPIDLSGQGQNKLLIGAENVTYQPKKWCMFNTEAKDLTKLAANIDYACTFSDCTALGYGSSCNTLDANGNASYAFNMYFQVKNQDEDACIFQGLATITTKNISQGQCNFPIQIVASTASSFSSSLVLLIAGVWFLLSGVMFEV

SEQ ID NO: 51241 - protein, 198 aa, Oryza sativa; identical to SEQ ID NO: 9759
  misc_feature: Useful for making plants with modulated biomass

SEQ ID NO: 51242 - protein, 162 aa, Arabidopsis thaliana
  misc_feature: Useful for making plants with modulated salt sensitivity
MVAISEIKSTVDVTAANCLMLLSRVGQENVDGGDQKRVFTCKTCLKQFHSFQALGGHRASHKKPNNDALSSRLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 51243 - protein, 223 aa, Arabidopsis thaliana
  misc_feature: Useful for making plants with altered lignin content
MARFEPYNYNNGHDPFFAHINQNPELINLDLPASTPSSFMLFSNGALVDANHNNSHFFPNLLHGNTRRKGNKEESGSKRRRKRSEEEEAMNGDETQKPKDVVHVRAKRGQATDSHSLAERVRREKINERLKCLQDLVPGCYKAMGMAVMLDVIIDYVRSLQNQIEFLSMKLSAASACYDLNSLDIEPTDIFQGGNIHSAAEMERILRESVGTQPPNFSSTLPF

SEQ ID NO: 51244 - protein, 472 aa, Panicum virgatum; identical to SEQ ID NO: 2874
  misc_feature: Useful for making plants with altered carbohydrate content

SEQ ID NO: 51245 - protein, 381 aa, Panicum virgatum
  misc_feature: Useful for making plants with altered carbohydrate content
MDGDRVPSGESTRRSLFGYIGFLLAIALVVFVGFVKGAISCYIPPSFWVFQTRRTELSRILPVHRFNQKVRRYSTNISRYFSATKTRLNEKTWSNMLFFWVVALIGIVNVCIAVHFLFSGIGAEEAYTYKGQHSQFTMVTMTYEARLWNLKLFVEHYSRCESVREIVVVWNKGNPPSSDAFDSTVPVRIRVEEINSLNNRFRVDPLIKTRAVFELDDDIMMTCSDLEKGFRVWREHPERMVGFYPRMIDGNPLQYRNERYARGKRGYNLILTGAAFMDSEFAFKKYWSEEAREGRDYVHKNFNCEDLLMNFLYANASSSRTVEYVHPAWAIDTSKLSSVAISRNTQKHYDIRTNCLAKFSSIYGPLPQKWEFGMREDRWDT

SEQ ID NO: 51246 - protein, 537 aa, Arabidopsis thaliana
  misc_feature: Useful for biocontainment applications
  misc_feature: Useful for making plants with modulated time to senescence
MTIDMYLSFASRSGSSPFPSLELCLSIFLFISLFVFWLTPGGFAWALYKARFHTRPESKTGPAIPGPSGLPIFGLLLAFVNNALTHRILANIADTCKAKALMAFSVGSTRFVITSEPETAKELLNSSAFADRPVKESAYELLFDRAMGFAPFGDYWRELRRISSTHLFSPKRIFSSGESRRKIGQNMVGEIKNAMECYGEVHIKKILHFGSLNNVMSSVFGKTYNFNEGIVYSKESNELEHLVSEGYELLGIFNWSDHFPGMRWLDLQGVRRRCRSLVGRVNVFVGKIINDHKSKRSLRDNPEESTYDDDFVDVLLGMHGNSKLSDSDMIAVLWEMIFRGTDTVAILLEWILARMVLHPDIQAKAQAEIDCIVGDSGRQVTDSDLPKLPYVRAIVKETLRMHPPGPLLSWARLSIHDTQIGTHFIPAGTTAMVNMWAITHDEKVWPEAHEYKPERFLGAQESNNFPIMGSDLRLAPFGAGRRVCPGKSMGLATVELWLAQLLGSYKWVSCGEVDLSETLKLSLEMKNTLVCKAIPRG

SEQ ID NO: 51247 - protein, 372 aa, Panicum virgatum; identical to SEQ ID NO: 27472
  misc_feature: Useful for making plants with altered carbohydrate content

SEQ ID NO: 51248 - protein, 1931 aa, Arabidopsis thaliana
  misc_feature: Useful for making plants with altered cell wall content and/or composition
MSRAESSWERLVNAALRRDRTGGVAGGNQSSIVGYVPSSLSNNRDIDAILRAADEIQDEDPNIARILCEHGYSLAQNLDPNSEGRGVLQFKTGLMSVIKQKLAKREVGTIDRSQDILRLQEFYRLYREKNNVDTLKEEEKQLRESGAFTDELERKTVKRKRVFATLKVLGSVLEQLAKEIPEELKHVIDSDAAMSEDTIAYNIIPLDAPVTTNATTTFPEVQAAVAALKYFPGLPKLPPDFPIPATRTADMLDFLHYIFGFQKDSVSNQREHIVLLLANEQSRLNIPEETEPKLDDAAVRKVFLKSLENYIKWCDYLCIQPAWSNLEAINGDKKLLFLSLYFLIWGEAANIRFLPECLCYIFHHMVREMDEILRQQVARPAESCMPVDSRGSDDGVSFLDHVIAPLYGVVSAEAFNNDNGRAPHSAWRNYDDFNEYFWSLHSFELGWPWRTSSSFFQKPIPRKKLKTGRAKHRGKTSFVEHRTFLHLYHSFHRLWIFLAMMFQALAIIAFNKDDLTSRKTLLQILSLGPTFVVMKFSESVLEVIMMYGAYSTTRRLAVSRIFLRFIWFGLASVFISFLYVKSLKAPNSDSPIVQLYLIVIAIYGGVQFFFSILMRIPTCHNIANKCDRWPVIRFFKWMRQERHYVGRGMYERTSDFINLLPINFNDYYTVVFLLVWEKQQTYLYLLFWLVVLSAKFSFAYFLQIKPLVGPTRMIVKQNNIPYSWHDFVSRKNYNALTVASLWAPVVAIYLLDIHIFYTIFSAFLGFLLGARDRLGEIRSLEAIHKLFEEFPGAFMRALHVPLTNRQGDWHVISSHYCCSYLHVIINSKTVDKKNKVDAAHFAPFWNQIIKSLREEDYITDFEMELLLMPKNSGRLELVQWPLFLLSSKILLAKEIAAESNSQEEILERIERDDYMKYAVEEVYHTLKLVLTETLEAEGRLWVERIYEDIQTSLKERNIHHDFQLNKLSLVITRVTALLGILKENETPEHAKGAIKALQDLYDVMRLDILTFNMRGHYETWNLLTQAWNEGRLFTKLKWPKDPELKALVKRLYSLFTIKDSAAHVPRNLEARRRLQFFTNSLFMDVPPPKSVRKMLSFSVFTPYYSEVVLYSMAELTKRNEDGISILFYLQKIYPDEWKNFLARIGRDENALEGDLDNERDILELRFWASYRGQTLARTVRGMMYYRKALMLQSYLERKAGNDATDAEGFELSPEARAQADLKFTYVVTCQIYGRQKEDQKPEAVDIALLMQRNEALRIAYIDVVDSPKEGKSHTEYYSKLVKADISGKDKEIYSIKLPGDPKLGEGKPENQNHAIVFTRGNAIQTIDMNQDNYFEEALKMRNLLEEFDRDHGIRPPTILGVREHVFTGSVSSLASFMSNQETSFVTLGQRVLAKPLKIRMHYGHPDVFDRVFHITRGGISKASRVINISEDIFAGFNTTLRQGNVTHHEYIQVGKGRDVGLNQIALFEGKVAGGNGEQVLSRDVYRLGQLLDFFRMMSFFFTTVGFYLCTMLTVLTVYIFLYGRAYLALSGVGATIRERAILLDDTALSAALNAQFLFQIGVFTAVPMVLGFILEQGFLQAIVSFITMQFQLCTVFFTFSLGTRTHYFGRTILHGGARYQATGRGFVVKHIKFSENYRLYSRSHFVKAMEVILLLVVYLAYGNDEAGAVSYILLTVSSWFLAVSWLFAPYLFNPAGFEWQKVVEDFKEWTNWLFYRGGIGVKGAESWEAWWEEELSHIRTLSGRIMETILSLRFFIFQYGIVYKLKLQGSDTSFAVYGWSWVAFAMIIVLFKVFTFSQKISVNFQLLLRFIQGLSLLMALAGIIVAVVLTPLSVTDIFACVLAFIPTGWGILSIACAWKPVLKRMGMWKSIRSLARLYDALMGMLIFLPVALCSWFPFVSTFQTRMMFNQAFSRGLEISLILAGDNPNSGL

SEQ ID NO: 51249 - protein, 631 aa, Arabidopsis thaliana
  misc_feature: Useful for making plants with altered cell wall content and/or composition
MENRFLQLTLSNPEGFVTGIQYNGIDNVLAYYTNKEYDRGYWDVVWNFPGKKAKKTKGTLDRIEATKMEVITQNDEKIELSFTRTWNTSSTTAVPVNIDKRFVMLQNSSGFYSYAIFERLQGWPAVELDNMRLVFKLNKKKFHYMAISDDRQRYMPVPDDRVPPRGQPLAYPEAVQLLDPIEPEFKGEVDDKYEYSMESKDIKVHGWISTNDSVGFWQITPSNEFRSAGPLKQFLGSHVGPTNLAVFHSTHYVGADLIMSFKNGEAWKKVFGPVFIYLNSFPKGVDPLLLWHEAKNQTKIEEEKWPYNFTASDDFPASDQRGSVSGRLLVRDRFISSEDIPANGSYVGLAAPGDVGSWQRECKGYQFWSKADENGSFSINNVRSGRYNLYAFAPGFIGDYHNDTVFDISPGSKISLGDLVYEPPRDGSTLWEIGVPDRSAAEFYIPDPNPSFVNKLYLNHSDKYRQYGLWERYSELYPDEDMVYNVDIDDYSKNWFFMQVTRKQANGGYKGTTWQIRFQFDDKMKNVTGNFKLRIALATSNVAELQVRVNDLSADPPLFRTEQIGRDNTIARHGIHGLYWLYSVNVPAASLHVGNNTIYLTQALATSPFQGLMYDYIRLEYPDSINYITRS

SEQ ID NO: 51250 - protein, 434 aa, Arabidopsis thaliana
  misc_feature: Useful for making plants with modulated drought sensitivity
MEEVSPAIAGPFRPFSETQMDFTGIRLGKGYCNNQYSNQDSENGDLMVSLPETSSCSVSGSHGSESRKVLISRINSPNLNMKESAAADIVVVDISAGDEINGSDITSEKKMISRTESRSLFEFKSVPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKPRRKLKSKPLN

SEQ ID NO: 51251 - protein, 402 aa, Arabidopsis thaliana; identical to SEQ ID NO: 9234
  misc_feature: Useful for making plants with modulated oxidative stress sensitivity

SEQ ID NO: 51252 - protein, 474 aa, Panicum virgatum; identical to SEQ ID NO: 27597
  misc_feature: Useful for making plants with altered carbohydrate content

SEQ ID NO: 51253 - protein, 587 aa, Oryza sativa subsp. japonica
  misc_feature: Useful for making plants with modulated water use efficiency
MGAMAMVEQEGCVENRQPLAASSSSVSDGSSYGGGGGGLAQMSPPVSSSANSISGLRRTSGPIRRAKGGWTPEEDETLRKAVEAYKGRNWKKIAECFPYRTEVQCLHRWQKVLNPELIKGPWTQEEDDQIIDLVKKYGPTKWSVIAKALPGRIGKQCRERWHNHLNPEIRKDAWTTEEEQALINAHRIYGNKWAEIAKVLPGRTDNSIKNHWNSSLRKKQDMYNTSNNMVVPKLLVHDKFKDKPKLMAMEGHLDLNKAPIINSKDQPGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPVSSSLFSDHLTGNHTSEHCGDDILSPAGCTTPPPTKGKLTSQLSVDSILKSAANSFPGTPSILKRRKRDKSTPVSASEMKISGSNTDRFYTPMGMEPATATPESFKTTSFLSLGSLDGSVKSFDVSPQYRARSKRMALTKTVEKQLDFSSDGLDTCGSEILNSSCNNSQSTLSITEAPKLKEKEHAVQLENLTKNFAHTTNLDVT

SEQ ID NO: 51254 - protein, 208 aa, Panicum virgatum; identical to SEQ ID NO: 27626
  misc_feature: Useful for making plants with modulated biomass

SEQ ID NO: 51255 - protein, 379 aa, Arabidopsis thaliana
  misc_feature: Useful for making plants with modulated oxidative stress sensitivity
MPASFKVIHDPIKETDSINADFGESAIGRVAPVDSGFWWIILLRAYTKSTGDTSLAETSECQKGMRLILSLCLSEGFDTFPTLLCADGCSMIDRRMGVYGYPIEIQALFFMALRSAMSMLKHDAEGKEFMERIVKRLHALSFHMRSYFWLDFQQLNDIYRYKTEEYSHTAVNKFNVIPDSIPEWVFDFMPLRGGYFIGNVSPARMDFRWFALGNCVAILASLATPEQSASIMDLIEERWEELVGAMPVKICHPAIESHEWRIVTGCDPKNTRWSYHNGGSWPVLLWLLTAACIKTGRPQIARRAIDLAEARLLKDGWPEYYDGKSGRFIGKQARKFQTWSIAGYLVAKMLLEDPSHLGMISLEEDKQTKPVIKRSYSWT

SEQ ID NO: 51256 - protein, 461 aa, Panicum virgatum; identical to SEQ ID NO: 718
  misc_feature: Useful for making plants with altered carbohydrate content

SEQ ID NO: 51257 - protein, 456 aa, Arabidopsis thaliana
  misc_feature: Useful for making plants with altered cell wall content and/or composition
MALSILFLLLFILFSISPSNAQSFIGVNYGLLSDNLPPPSQTAKLLQSTSIQKVRLYNADSSIITSLVGTGIGIVIGVANGDLPSIASDLNIASQWINSNVLPFYPASNIILINVGNEVLLSNDLNLVNQLLPAMQNVQKALEAVSLGGKIKVSTVHAMTVLGNSEPPSAGSFAPSYQAGLKGILQFLSDTGSPFAINPYPFFAYQSDPRPETLAFCLFQPNPGRVDSNTGIKYMNMFDAQVDAVHSALKSIGFEKVEVLVAETGWPSTGDSNEVGPSVENAKAYNGNLIAHLRSMVGTPLMPGKSIDTYIFALFDENLKPGPSFEQSFGLFKPDLSMAYDIGLTKTTSSQTSQSPQLGKVTSMGWCVPKEDATQEQLQDSLDWVCGQGIDCGPIMPGGVCFEPNNVASHTAYAMNLYFQKSPENPTDCDFSKTARITSENPSKLFSSSSFISYLL

SEQ ID NO: 51258 - protein, 497 aa, Panicum virgatum; identical to SEQ ID NO: 3416
  misc_feature: Useful for making plants with altered carbohydrate content

SEQ ID NO: 51259 - protein, 248 aa, Arabidopsis thaliana
  misc_feature: Useful for making plants with altered terpenoid content
  misc_feature: Useful for making plants with modulated flowering time
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 51260 - protein, 161 aa, Arabidopsis thaliana; identical to SEQ ID NO: 9434
  misc_feature: Useful for making plants with modulated oxidative stress sensitivity

SEQ ID NO: 51261 - protein, 205 aa, Zea mays
  misc_feature: Useful for biocontainment applications
MDMVSQSEHLCYVRCTYCNTVLAVGVPCKRLMDTVTVKCGHCNNLSYLSPRPPMVQPLSPTDHPLGPFQCQGPCNDCRRNQPLPLASPSSTELSPRMPFVVKPPEKKHRLPSAYNRFMREEIQRIKAAKPDIPHREAFSMAAKNWAKCDPRCSTAASTETSNSAPAEPRVVPTPQLTEPRFDLEDRAKGQVIESFDIFKHIERSI

SEQ ID NO: 51262 - protein, 181 aa, Arabidopsis thaliana
  misc_feature: Useful for biocontainment applications
  misc_feature: Useful for making plants with modulated flowering time
MNLEEKPTMTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWATYIPNSPTSITSGGHNMIHGLGFGEKK

SEQ ID NO: 51263 - protein, 255 aa, Glycine max
  misc_feature: Useful for making plants with modulated flowering time
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 51264 - protein, 75 aa, Zea mays
  misc_feature: Useful for making plants with modulated biomass
  misc_feature: Useful for making plants with modulated flowering time
MEPKKSSAQHQPHAMEPKKSSPRGAGAVAATATEAESPLSSLFYPPAPAANGKDQELYSIIYKGQSGSATSWRDR

SEQ ID NO: 51265 - protein, 160 aa, Arabidopsis thaliana
  misc_feature: Useful for making plants with modulated heat sensitivity
MTKFRKLGRPAGHRMSMLRTMVSQLVKHERIETTVTKAKEVRRLADNMIQLGKEGSLSAARRAAGFVRGDDVLHKIFTELAHRYKDRAGGYTRLLRTRIRVGDAAPMAYIEFIDRENELRQSKPATPQPPQRVPLDPWERSRLTRQFAPPKEEKIPDSEL

SEQ ID NO: 51266 - protein, 111 aa, Arabidopsis thaliana; identical to SEQ ID NO: 9497
  misc_feature: Useful for biocontainment applications
  misc_feature: Useful for making plants with modulated biomass

SEQ ID NO: 51267 - protein, 317 aa, Arabidopsis thaliana
  misc_feature: Useful for making plants with altered cell wall content and/or composition
MATTRMVRVSQDGSGDYCSVQDAIDSVPLGNTCRTVIRLSPGIYRQPVYVPKRKNFITFAGISPEITVLTWNNTASKIEHHQASRVIGTGTFGCGSVIVEGEDFIAENITFENSAPEGSGQAVAIRVTADRCAFYNCRFLGWQDTLYLHHGKQYLKDCYIEGSVDFIFGNSTALLEHCHIHCKSQGFITAQSRKSSQESTGYVFLRCVITGNGQSGYMYLGRPWGPFGRVVLAYTYMDACIRNVGWHNWGNAENERSACFYEYRCFGPGSCSSERVPWSRELMDDEAGHFVHHSFVDPEQDRPWLCLRMGVKTPYSA

SEQ ID NO: 51268 - protein, 382 aa, Panicum virgatum; identical to SEQ ID NO: 5988
  misc_feature: Useful for making plants with altered carbohydrate content

SEQ ID NO: 51269 - protein, 367 aa, Arabidopsis thaliana
  misc_feature: Useful for making plants with modulated biomass
MGHHSCCNKQKVKRGLWSPEEDEKLINYINSYGHGCWSSVPKHAGTYTHIHGFCLQRCGKSCRLRWINYLRPDLKRGSFSPQEAALIIELHSILGNRWAQIAKHLPGRTDNEVKNFWNSSIKKKLMSHHHHGHHHHHLSSMASLLTNLPYHNGFNPTTVDDESSRFMSNIITNTNPNFITPSHLSLPSPHVMTPLMFPTSREGDFKFLTTNNPNQSHHHDNNHYNNLDILSPTPTINNHHQPSLSSCPHDNNLQWPALPDFPASTISGFQETLQDYDDANKLNVFVTPFNDNAKKLLCGEVLEGKVLSSSSPISQDHGLFLPTTYNFQMTSTSDHQHHHRVDSYINHMIIPSSSSSSPISCGQYVIT

SEQ ID NO: 51270 - protein, 397 aa, Zea mays; identical to SEQ ID NO: 9384
  misc_feature: Useful for making plants with modulated oxidative stress sensitivity

SEQ ID NO: 51271 - protein, 481 aa, Arabidopsis thaliana
  misc_feature: Useful for making plants with modulated heat sensitivity
MESVPESVPSPNSNTPSIPPPVNSVPPFLSKTYDMVDDPLTNEVVSWSSGNNSFVVWSAPEFSKVLLPKYFKHNNFSSFVRQLNTYGFRKVDPDRWEFANEGFLRGRKQLLKSIVRRKPSHVQQNQQQTQVQSSSVGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDDILSGSVENNDLVLEQEPNEWTRNEQQMKYLTEQMGLLSSEAQRK

SEQ ID NO: 51272 - protein, 339 aa, Panicum virgatum; identical to SEQ ID NO: 4118
  misc_feature: Useful for making plants with altered carbohydrate content

SEQ ID NO: 51273 - protein, 619 aa, Arabidopsis thaliana
  misc_feature: Useful for making plants with altered cell wall content and/or composition
MFPRVSMRRRSAEVSPTEPMEKGNGKNQTNRICLLVALSLFFWALLLYFHFVVLGTSNIDKQLQLQPSYAQSQPSSVSLRVDKFPIEPHAAPSKPPPKEPLVTIDKPILPPAPVANSSSTFKPPRIVESGKKQEFSFIRALKTVDNKSDPCGGKYIYVHNLPSKFNEDMLRDCKKLSLWTNMCKFTTNAGLGPPLENVEGVFSDEGWYATNQFAVDVIFSNRMKQYKCLTNDSSLAAAIFVPFYAGFDIARYLWGYNISRRDAASLELVDWLMKRPEWDIMRGKDHFLVAGRITWDFRRLSEEETDWGNKLLFLPAAKNMSMLVVESSPWNANDFGIPYPTYFHPAKDSEVFEWQDRMRNLERKWLFSFAGAPRPDNPKSIRGQIIDQCRNSNVGKLLECDFGESKCHAPSSIMQMFQSSLFCLQPQGDSYTRRSAFDSMLAGCIPVFFHPGSAYTQYTWHLPKNYTTYSVFIPEDDVRKRNISIEERLLQIPAKQVKIMRENVINLIPRLIYADPRSELETQKDAFDVSVQAVIDKVTRLRKNMIEGRTEYDYFVEENSWKYALLEEGQREAGGHVWDPFFSKPKPGEDGSSDGNGGTTISADAAKNSWKSEQRDKTQ

SEQ ID NO: 51274 - protein, 255 aa, Arabidopsis thaliana
  misc_feature: Useful for making plants with modulated drought sensitivity
MTVGVLALQGSFNEHIAALRRLGVQGVEIRKADQLLTVSSLIIPGGESTTMAKLAEYHNLFPALREFVKMGKPVWGTCAGLIFLADRAVGQKEGGQELVGGLDCTVHRNFFGSQIQSFEADILVPQLTSQEGGPETYRGVFIRAPAVLDVGPDVEVLADYPVPSNKVLYSSSTVQIQEEDALPETKVIVAVKQGNLLATAFHPELTADTRWHSYFIKMTKEIEQGASSSSSKTIVSVGETSAGPEPAKPDLPIFQ

SEQ ID NO: 51275 - protein, 511 aa, Panicum virgatum
  misc_feature: Useful for making plants with altered carbohydrate content
MPAAARSVKELAAAGVVLAMLLSAAAAQHDYGDALHKCILFFEGQRSGRLPPDQRVRWRRDSGLHDGAAAGVDLTGGYYDAGDNVKFEFPMAFTATLMSWGLIDFGRSFGPNREEARKAVRWATDYLMKATARPNTVYVQVGDAFRDHACWERPEDMDTPRTVYKVDPSHPGSDVAAETAAALAAASIVFRDSDPGYSKRLLDRAVAVFEFADKHRGPYSSSLHAAVCPCYCDYSGYQDELLWGAAWLHKASRRREYREYIKRNEVVLGASDAINEFGWDNKHAGINVLISKEVLMGKDEYFQSFRVNADNFMCTLLPGISNHPQIQYSPGGLLFKVGSSNMQHVTQLSFLLLAYSNYLSHAGGRVSCGSSSASPAQLRRVAKRQVDYILGDNPLRMSYMVGYGARFPRRMSTTAPARCRRWRRTRRGSAARPAPPTTPARRPTRTCSSAPSSAGPATPLTPSRTRAPCSSSRSPPRTSTRRSWASSPTSRPTPTRPTPAATENIGLRMEW

SEQ ID NO: 51276 - protein, 492 aa, Arabidopsis thaliana
  misc_feature: Useful for making plants with altered cell wall content and/or composition
MARKSLIFPVILLAVLLFSPPIYSAGHDYRDALRKSILFFEGQRSGKLPPDQRLKWRRDSALRDGSSAGVDLSGGYYDAGDNIKFGFPMAFTTTMLSWSIIDFGKTMGPELRNAVKAVKWGTDYLLKATAIPGVVFVQVGDAYSDHNCWERPEDMDTLRTVYKIDRAHPGSDVAGETAAALAAASIVFRKRDPAYSRLLLDRATRVFAFANRYRGAYSNSLYHAVCPFYCDFNGYQDELLWGAAWLHKASRKRAYREFIVKNEVILKAGDTINEFGWDNKHAGINVLISKEVLMGKAEYFESFKQNADGFICSILPGISHPQVQYSRGGLLVKTGGSNMQHVTSLSFLLLAYSNYLSHAKKVVPCGELTASPSLLRQIAKRQVDYILGDNPMGLSYMVGYGQKFPRRIHHRGSSVPSVSAHPSHIGCKEGSRYFLSPNPNPNLLVGAVVGGPNVTDAFPDSRPYFQQSEPTTYINAPLVGLLGYFSAHSTWR

SEQ ID NO: 51277 - protein, 623 aa, Arabidopsis thaliana
  misc_feature: Useful for making plants with altered cell wall content and/or composition
MHPGNVWGGSLDAVDSDRIAAEEEERLRNTTEWDRGAIHSQRSELDETQQGWLLAPQDNWRKKKKKYVNLGCVSVSRTVFLWTVGSIAVLFLVVALPIIIVKSLPRHKSAPPPPDNYTLALHKALQFFDAQKSGKLPKKNKVSWRGDSGTKDGLPDVVGGLVGGYYDGGSNVKFHFPMAFSMTMLSWSLIEYSHKYKAIDEYDHMRDVLKWGTDYLLLTFNNSATRLDHIYTQVGGGLRDSESPDDIYCWQKPEDMSYDRPVLSSTSAADLGAEVSAALAAASIVFTDKPDYAKKLKKGAETLYPFFRSKSRRKRYSDGQPTAQAFYNSTSMFDEFMWAGAWLYYATGNKTYIQFATTPSVPQTAKAFANRPELMVPSWNNKLPGAMLLMTRYRLFLNPGFPYENMLNRYHNATGITMCAYLKQYNVFNRTSGGLMQLNLGKPRPLEYVAHASFLASLFADYLNSTGVPGWYCGPTFVENHVLKDFAQSQIDYILGDNPLKMSYVVGFGKKFPRRVHHRGATIPNDKKRRSCREGLKYRDTKNPNPNNITGAMVGGPNKFDEFHDLRNNYNASEPTLSGNAGLVAALVSLTSSGGQQIDKNTMFNSVPPLYSPTPPPPKAWKP

SEQ ID NO: 51278 - protein, 346 aa, Panicum virgatum; identical to SEQ ID NO: 1764
  misc_feature: Useful for making plants with altered carbohydrate content

SEQ ID NO: 51279 - protein, 160 aa, Arabidopsis thaliana
  misc_feature: Useful for making plants with modulated water use efficiency
MAQRTEKEETEFKVLETLTTTTTTLCTNNCGVTANPATNNMCQKCFNASLVSAAAGVVESGSILKRSARSVNLRSSPAKVVIRPREIDAVKKRDQQIVNRCSGCRKKVGLTGFRCRCGELFCSEHRYSDRHDCSYDYKTAGREAIARENPVVKAAKMVKV

SEQ ID NO: 51280 - protein, 163 aa, Arabidopsis thaliana; identical to SEQ ID NO: 9272
  misc_feature: Useful for making plants with altered lignin content

SEQ ID NO: 51281 - protein, 161 aa, Arabidopsis thaliana; identical to SEQ ID NO: 9336
  misc_feature: Useful for making plants with modulated nitrogen use efficiency

SEQ ID NO: 51282 - protein, 449 aa, Arabidopsis thaliana
  misc_feature: Useful for making plants with altered cell wall content and/or composition
MAKAPPSISLLLLLCAAVFLTIPAVISAIGVNYGTLGNLPPPTQVANFIKTQTSIDSVKIFDVNPDILRAFAGTGISVVVTVPNGDIPALANGRQARRWVSVNILPFHPQTKIKYISVGNEILLTGDNNMINNLLPAMRNLNNALVRAGVRDVKVTTAHSLNIIAYDLTGAPSSGRFRPGWDKGILAPILAYHRRTKSPFMVNPYPYFGFDPKNVNFAIFRTPYKAVRDPFTRHVYTNMFDALMDSTYSAMKALGYGDVNIVVGETGWPSACDAPWCSPANAAWFNLNIIKRAQGQGTPLMPNRRFETYIFGLFNEEGKPGPTAERNWGLFRADFSPVYDVGLLRNGQGGGGRPALPAPSTAGGKWCVARSGATNTQLQDSINWVCGQGVDCKPIQAGGSCFNPSSLRTHASFVMNAYFQSHGRTDGACNFSGTGMIVGNNPSNGACKY

SEQ ID NO: 51283 - protein, 551 aa, Arabidopsis thaliana
  misc_feature: Useful for making plants with altered cell wall content and/or composition
MSSILILLFSLFLFSSPSSSSRHHHHHNSGDTSPVNPSSSLAAQIRLACNATRYPDQCVSSLSEQGRVPPDPKPIQIIHSAISFSFQNLKTAQSKIKSIVDSSVGNLNRTNAANTCLQLLTYSEHRTQSTDQALTRGKIKDARAWMSAALVYQYDSWSALKYVNDTSQVGETMSFLDGLIHVTSNALSMMVSYDNFGDNVASWTYPATERDGFWEKTGPGLGLDPSTGLNLGFPSGLKEDVTVCKDGKCGYKTVQDAVNAAPEDNGMRKFVIKISEGVYEENVIVPFEKKNVVFIGDGMGKTVITGSLNAGMPGITTYNTATVGVVGDGFMARDLTFQNTAGPDAHQAVAFRSDSDFSLIENCEFLGNQDTLYAHGLRQFYKNCRIQGNVDFIFGNSAAVFQDCEILIAPRQINPEKGEKNAVTAQGRIDPSQSTGFVFLNCLINGTEEYMKLFKANPKVHKNFLGRPWKDYSRTVFIGCNLEALITPDGWLPWSGDFALKTLYYGESKNTGPGSDRSQRVSWSSQIPDEHVHVYSVANFIQADEWASMSA

SEQ ID NO: 51284 - protein, 78 aa, Zea mays
  misc_feature: Useful for making plants with modulated salt sensitivity
MGPRYITLCIFLVLVLHGDTTLAETCRQFVKWDPFCFSAMCKASCFIEGKSSDGSYVKGHRCESNGYHAVCVCFLCKN

SEQ ID NO: 51285 - protein, 299 aa, Arabidopsis thaliana
  misc_feature: Useful for biocontainment applications
MNSPPVDAMITGESSSQRSIPTPFLTKTFNLVEDSSIDDVISWNEDGSSFIVWNPTDFAKDLLPKHFKHNNFSSFVRQLNTYGFKKVVPDRWEFSNDFFKRGEKRLLREIQRRKITTTHQTVVAPSSEQRNQTMVVSPSNSGEDNNNNQVMSSSPSSWYCHQTKTTGNGGLSVELLEENEKLRSQNIQLNRELTQMKSICDNIYSLMSNYVGSQPTDRSYSPGGSSSQPMEFLPAKRFSEMEIEEEEEASPRLFGVPIGLKRTRSEGVQVKTTAVVGENSDEETPWLRHYNRTNQRVCN

SEQ ID NO: 51286 - protein, 194 aa, Glycine max
  misc_feature: Useful for biocontainment applications
  misc_feature: Useful for making plants with modulated flowering time
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVVLEKEFVFVDSLDAWMYQPPFGFDTEQDTGFEGLMWNY

SEQ ID NO: 51287 - protein, 131 aa, Glycine max
  misc_feature: Useful for making plants with modulated biomass
  misc_feature: Useful for making plants with modulated flowering time
  misc_feature (115)..(115): Xaa is any aa, unknown, or other
  misc_feature (116)..(116): Xaa is any aa, unknown, or other
MTSSNRSSSPTSSSSDQSDVTTTTSTHLSETSPRNNKRKRSKDSSSSSSSSSSKLKHPVYRGVRMRSWGKWVSEIRQPRKKTRIWLGTFATADMAARAHDVAALAIKGSSAVINXXGACLYPPSSGVILAA

SEQ ID NO: 51288 - protein, 87 aa, Arabidopsis thaliana; identical to SEQ ID NO: 9363
  misc_feature: Useful for making plants with altered alkaloid content
  misc_feature: Useful for making plants with altered terpenoid content

SEQ ID NO: 51289 - protein, 597 aa, Arabidopsis thaliana
  misc_feature: Useful for making plants with modulated biomass
  misc_feature: Useful for making plants with modulated flowering time
MMFRGILKSAKDEKKKMESQGNGAVANSGKSLVNRRRANKEKKMDLLQDVDKLKRKLRQEENVHRALERAFTRPLGALPRLPSYLPRHTLELLAEVAVLEEEVVRLEEQVVNFRQGLYQEAVYISSKRNLESPNNNSLNENSPVRSTKHQRSKSMSQHEFNSMITPTKKHQQSLSRSISSRKLFSSDQTVNDRSGQRVVSGKQASPKSNLSSVTNTKPVDVRGKENQTSSNASKDKKNKESPEKKLGRFLTSVKKKKPLIKPEAAADKHSESTKLQLDDRLADQDKAQESVSGSSSEDKTLQSGNVANRVSEDLLKCLVTIILRISSSKDIVLDPYNNCSEWRTRELGAYKHFSSVDTSSVDLGRRINASFLIHRLKFLLNKLSVVNLDGLSHQQKLAFWINTYNSCVMNAFLEHGIPATPEMVVALMQKATIIVGGHSLNAITIEHFILRLPYHLKFTCPKTATHEEMRAHSTFGLEWSEPLVTFALACGSWSSPAVRVYTAANVEEELEAAKRDYLQASVGISKNNKLMLPKVLDWYLLDFAKDLESLLDWVCLQLPDKLREEATKCMERKNKESLMELVQVVPYDFSFRLLLHQ

SEQ ID NO: 51290 - protein, 451 aa, Arabidopsis thaliana
  misc_feature: Useful for making plants with altered lignin content
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQEIQSASKSLININEPPRETAPLDIESDQQNHHENDLKPEEHNNNNNYDENEETLKREQMEEEERPPRPVCVLNKEAPLPLLQYKRRRQSESNNNSSRNTQDHCSSTTTTVDNTTTLISSSAAATNTAISALLEFSLMGISDKKEKPQQPLRPHKEPLPPQTPLASPEEKVNDLQKEIHQMSVERETFKLEMMSAEAMISILQSRIDALRQENEELKKNNANGQ

SEQ ID NO: 51291 - protein, 341 aa, Arabidopsis thaliana
  misc_feature: Useful for making plants with altered cell wall content and/or composition
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 51292 - protein, 750 aa, Arabidopsis thaliana
  misc_feature: Useful for making plants with altered cell wall content and/or composition
MLRFIIFFSLFIHLCVAAPQTPAAAAAVPAKKWLTLNGQEPAVVARGGFSGLFPESSASANDLAIGTSSPGLTMLCNLQMTKDGVGLCLSDIILDNATTISSVFPKAQKTYKVNGQDLKGWFVLDYDADTIFNNVTLVQNIFSRPSIFDGQMSVSAVEDVLGTKPPKFWLSVQYDAFYMEHKLSPAEYLRSLQFRGINVISSPEIGFLKSIGMDAGRAKTKLIFEFKDPEAVEPTTNKKYSEIQQNLAAIKAFASGVLVPKDYIWPIDSAKYLKPATTFVADAHKAGLEVYASGFANDLRTSFNYSYDPSAEYLQFVDNGQFSVDGVITDFPPTASQSITCFSHQNGNLPKAGHALVITHNGASGDYPGCTDLAYQKAVDDGADVIDCSVQMSKDGIAFCHDAADLTASTTAMTIFMSRATSVPEIQPTNGIFSFDLTWAEIQSVKPQIENPFTATGFQRNPANKNAGKFITLADFLDFSKAKAVTGVMINIENAAYLASKKGLGVVDAVKSALAKSTLDKQSTQKVLIQSDDSSVLASFEAVPPYTRVLSIDKEIGGAPKPSVDEIKKYAEAVNLLRTSLVTVSQSFTTGKTNVVEEMHKGNISVYVSVLRNEYISVAFDYFSDPTIELATFISGSGVDGVITEFPATATRYLKSPCSDLNKEQPYAILPAEAGGLVVVADKEAQPPASAPNPPLEAKDVIDPPLPPVANLAASNATGGAQSHPPPASGTVANAANLGLSLLAMLALGV

SEQ ID NO: 51293 - protein, 302 aa, Glycine max
  misc_feature: Useful for making plants with modulated nitrogen use efficiency
MGRAPCCDKANVKRGPWSPEEDATLKNYVETHGTGGNWIALPKKAGLRRCGKSCRLRWLNYLRPDIKHGGFTEEEDNIICTLYAEMGSRWSAIASKLPGRTDNDVKNYWNTKLKKKIMAGKVTLKTLTDNDTLPSISTPSLTNNQNVKTSQNSPFPSSQNQNSPPLDANNTFSISEKSIISFDQTHHGLYSPQVMDVVSQIGANSRIPNYNNNNNPVVSLSQEGSSSISDSSSIAMNNKNVSQPEQHANDDYESMEMLMDFGFGFPYDFANGPNCHYERVGELAPSSYPEWVDFSYADIKPH

SEQ ID NO: 51294 - protein, 329 aa, Arabidopsis thaliana
  misc_feature: Useful for making plants with modulated biomass
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDVNGIRSEIMMKQEEIMMMMMIDHHIDQRTKGYNGEFTQGYYNYYNGHGDLKQMISGTGTNSNINMGGSGSSSSSISNLAENKSSGSLLLEYKCLPYFYS

SEQ ID NO: 51295 - protein, 506 aa, Arabidopsis thaliana
  misc_feature: Useful for making plants with altered lignin content
  misc_feature: Useful for making plants with altered terpenoid content
MTTEDQTISSSGGYVQSSSTTDHVDHHHHDQHESLNPPLVKKKRNLPGNPDPEAEVIALSPKTLMATNRFLCEICGKGFQRDQNLQLHRRGHNLPWKLKQRTSKEVRKRVYVCPEKSCVHHHPTRALGDLTGIKKHFCRKHGEKKWKCEKCAKRYAVQSDWKAHSKTCGTREYRCDCGTIFSRRDSFITHRAFCDALAEETARLNAASHLKSFAATAGSNLNYHYLMGTLIPSPSLPQPPSFPFGPPQPQHHHHHQFPITTNNFDHQDVMKPASTLSLWSGGNINHHQQVTIEDRMAPQPHSPQEDYNWVFGNANNHGELITTSDSLITHDNNINIVQSKENANGATSLSVPSLFSSVDQITQDANAASVAVANMSATALLQKAAQMGATSSTSPTTTITTDQSAYLQSFASKSNQIVEDGGSDRFFASFGSNSVELMSNNNNGLHEIGNPRNGVTVVSGMGELQNYPWKRRRVDIGNAGGGGQTRDFLGVGVQTICHSSSINGWI

SEQ ID NO: 51296 - protein, 195 aa, Zea mays; identical to SEQ ID NO: 9457
  misc_feature: Useful for making plants with altered terpenoid content

SEQ ID NO: 51297 - protein, 470 aa, Panicum virgatum
  misc_feature: Useful for making plants with altered carbohydrate content
MKITVRGSEMVYPAAETPRRRLWNSGPDLVVPRFHTPSVYFFRRRDGEGNDLAAADGSFFDGARMRRALAEALVPFYPMAGRLARDEDGRVEIDCNAGGVLFQEADAPDATVDDFGDFAPTMELKRLIPTVEYTDDISAFPLLVVQVTHFKCGGVAIGVGMQHHVADGFSGLHFINSWADLCRGVPIAVMPYIDRSLLRARDPPTPVYPHVEYQPAPAMLSEPPQAPLMAKPATPPAAVAIFRLSRADLGRLRSQIPAREGVPRLSTYAVLAAHVWRCASLARGLPADQPTKLYCATDGRQRLQPPLPEGYFGNVIFTATPLADAGTVTAGVAEGAAVIPGGAGTGWTKGTAGRRWTTWSFSLTCRRWSAARTRSGAPTWGSPAGCGCPSTTRTSGGGGPCSWAPAASRTRGSRSCSPAPTATAACPWPSRCRPSTWRSSGSSSTTSDRLDTQHPSHRREKAQQKQAEKR

SEQ ID NO: 51298 - protein, 362 aa, Arabidopsis thaliana
  misc_feature: Useful for making plants with altered cell wall content and/or composition
MAQLTNSLNYLFSVSLLLFVSFHCLCFRFSLVAACSNSTDDQQIQHHHHRKWVGPSGHKVITVSLNGHAQFRSVQDAVDSIPKNNNKSITIKIAPGFYREKVVVPATKPYITFKGAGRDVTAIEWHDRASDLGANGQQLRTYQTASVTVYANYFTARNISFTNTAPAPLPGMQGWQAVAFRISGDKAFFSGCGFYGAQDTLCDDAGRHYFKECYIEGSIDFIFGNGRSMYKDCELHSIASRFGSIAAHGRTCPEEKTGFAFVGCRVTGTGPLYVGRAMGQYSRIVYAYTYFDALVAHGGWDDWDHKSNKSKTAFFGVYNCYGPGAAATRGVSWARALDYESAHPFIAKSFVNGRHWIAPRDA

SEQ ID NO: 51299 - protein, 412 aa, Panicum virgatum; identical to SEQ ID NO: 4070
  misc_feature: Useful for making plants with altered carbohydrate content

SEQ ID NO: 51300 - protein, 573 aa, Panicum virgatum; identical to SEQ ID NO: 29014
  misc_feature: Useful for making plants with altered carbohydrate content

SEQ ID NO: 51301 - protein, 386 aa, Panicum virgatum
  misc_feature: Useful for making plants with altered carbohydrate content
MNSGVMVVEPSETLFNDMIDKVGRLPSYTGGDQGFLNSYYPDFPNSRVYEPDSPLTPEPETQRLSTLYNADVGLYMLANKWMVDEKELRVIHYTLGPLKPWDWFTAWLVKPVGTWQDIRQKLEESLPGTGGGRNPHDQLVVKILFILPFCLLLFGYYQSCFQTNKELISIRSLCAFARRARHKYKSEEPLPSYSVVGSSAAFGISNQRLSNGTHSKLPPYFGPIAVLVCFISAGVSFAFAFAIIPRQVMPWTGLLLMFELTFVAFFLLFGSYLHFVYQWGSMSANHVGFNNSDSSENHIGSGHQRNMSDCDMDATFYWIGMAVIATVAVLLPTILGITALFTKLGLMVAGGVVLASFMTYAAEHLAISAFNKGQKDRNARTRSFCF

SEQ ID NO: 51302 - protein, 480 aa, Panicum virgatum; identical to SEQ ID NO: 806
  misc_feature: Useful for making plants with altered carbohydrate content

SEQ ID NO: 51303 - protein, 122 aa, Panicum virgatum; identical to SEQ ID NO: 6686
  misc_feature: Useful for making plants with altered carbohydrate content

SEQ ID NO: 51304 - protein, 189 aa, Panicum virgatum
  misc_feature: Useful for making plants with altered carbohydrate content
MAATLALAVVLAVASLQAEAVRLDVPQSGTKCVSEEIQSNVVVLSDYSIMYESHSYSHPTIAVKVTSPFGNALHHNENATVGQFAFTTAEAGNYLACFWIDSAEKGSGVSVNLDWKIGFATKDWDAIAKKEKIEGVELELRKLEVAVQAIHQNLIYLKAREADMRTVSEKTNARVAWFSILSLGVCIAV

SEQ ID NO: 51305 - protein, 136 aa, Arabidopsis thaliana; identical to SEQ ID NO: 9596
  misc_feature: Useful for making plants with modulated oxidative stress sensitivity

SEQ ID NO: 51306 - protein, 301 aa, Arabidopsis thaliana
  misc_feature: Useful for making plants with altered cell wall content and/or composition
MVADANGSSSSSFNFLIYGKTGWIGGLLGKLCEAQGITYTYGSGRLQDRQSIVADIESVKPSHVFNAAGVTGRPNVDWCESHKVETIRTNVAGTLTLADICREKGLVLINYATGCIFEYDSGHPLGSGIGFKEEDTPNFTGSFYSKTKAMVEELLKNYENVCTLRVRMPISSDLTNPRNFITKIARYEKVVDIPNSMTILDELLPISIEMAKRNLTGIYNFTNPGVVSHNEILEMYRDYIDPSFTWKNFTLEEQAKVIVAPRSNNELDATKLKTEFPELMSIKESLIKFVFEPNKKTEVKA

SEQ ID NO: 51307 - protein, 143 aa, Arabidopsis thaliana
  misc_feature: Useful for making plants with altered cell wall content and/or composition
MALSISIYFLLIFLSHFPSSHAEPFIGVNYGQVADNLPPPSETVKLLQSTSIQKVRLYGADPAIIKALAGTGVGIVIGAANGDVPSLASDPNAATQWINSNVLPFYPASKIMLITVGNEILMSNDPNLVNQLLPAMQNVQKAL

SEQ ID NO: 51308 - protein, 258 aa, Panicum virgatum; identical to SEQ ID NO: 1056
  misc_feature: Useful for making plants with altered carbohydrate content

SEQ ID NO: 51309 - protein, 259 aa, Arabidopsis thaliana; identical to SEQ ID NO: 9679
  misc_feature: Useful for making plants with altered cell wall content and/or composition
  misc_feature: Useful for making plants with altered lignin content

SEQ ID NO: 51310 - protein, 996 aa, Arabidopsis thaliana
  misc_feature: Useful for making plants with modulated light quality sensitivity
MEPTEKPSTKPSSRTLPRDTRGSLEVFNPSTQLTRPDNPVFRPEPPAWQNLSDPRGTSPQPRPQQEPAPSNPVRSDQEIAVTTSWMALKDPSPETISKKTITAEKPQKSAVAAEQRAAEWGLVLKTDTKTGKPQGVGVRNSGGTENDPNGKKTTSQRNSQNSCRSSGEMSDGDVPGGRSGIPRVSEDLKDALSTFQQTFVVSDATKPDYPIMYASAGFFNMTGYTSKEVVGRNCRFLQGSGTDADELAKIRETLAAGNNYCGRILNYKKDGTSFWNLLTIAPIKDESGKVLKFIGMQVEVSKHTEGAKEKALRPNGLPESLIRYDARQKDMATNSVTELVEAVKRPRALSESTNLHPFMTKSESDELPKKPARRMSENVVPSGRRNSGGGRRNSMQRINEIPEKKSRKSSLSFMGIKKKSESLDESIDDGFIEYGEEDDEISDRDERPESVDDKVRQKEMRKGIDLATTLERIEKNFVITDPRLPDNPIIFASDSFLELTEYSREEILGRNCRFLQGPETDLTTVKKIRNAIDNQTEVTVQLINYTKSGKKFWNIFHLQPMRDQKGEVQYFIGVQLDGSKHVEPVRNVIEETAVKEGEDLVKKTAVNIDEAVRELPDANMTPEDLWANHSKVVHCKPHRKDSPPWIAIQKVLESGEPIGLKHFKPVKPLGSGDTGSVHLVELVGTDQLFAMKAMDKAVMLNRNKVHRARAEREILDLLDHPFLPALYASFQTKTHICLITDYYPGGELFMLLDRQPRKVLKEDAVRFYAAQVVVALEYLHCQGIIYRDLKPENVLIQGNGDISLSDFDLSCLTSCKPQLLIPSIDEKKKKKQQKSQQTPIFMAEPMRASNSFVGTEEYIAPEIISGAGHTSAVDWWALGILMYEMLYGYTPFRGKTRQKTFTNVLQKDLKFPASIPASLQVKQLIFRLLQRDPKKRLGCFEGANEVKQHSFFKGINWALIRCTNPPELETPIFSGEAENGEKVVDPELEDLQTNVF

SEQ ID NO: 51311 - protein, 565 aa, Arabidopsis thaliana
  misc_feature: Useful for making plants with altered cell wall content and/or composition
MSHSFFNLFLISLFLYNNCIAHHYTFTVREVPYTKLCSTKAILTVNSQFPGPIIKVHKGDTIYVNVQNRASENITMHWHGVEQPRNPWSDGPEYITQCPIRPGSDFLYKVIFSIEDTTVWWHAHSSWTRATVHGLIFVYPRPPQILPFPKADHEVPIILGEWWKRDVREVVEEFVRTGGAPNVSDALTINGHPGFLYPCSKSDTFHLTVEKGKTYRIRMVNAAMNLPLFFAIANHSLTVVSADGHYIKPIKATYITISPGETLDMLLHADQDPERTYYMAARAYQSGNIDFNNSTTIGILSYTSSCKAKTSSFSGYYPTLPFYNDTSAAFGFFTKIKCLFSGQVPVQISRRIITTVSINLRMCPQNSCEGPNGSRLAASMNNISFVTPSHVDILKAYYYHIKGVYGTRFPEFPPLIFNFTAENQPLFLETPRLATEVKVIEFGQVVELVIQGTSLVGGGLDHPMHLHGFSFYVVGVGFGNYNISEEDPSSRYNLYDPPYKNTMTVPRNGWIAIRFVADNPGVWFMHCHLDRHQTWGMNVVFIVKNGREPNQQILPPPDDLPPCYE

SEQ ID NO: 51312 - protein, 656 aa, Panicum virgatum; identical to SEQ ID NO: 2778
  misc_feature: Useful for making plants with altered carbohydrate content

SEQ ID NO: 51313 - protein, 678 aa, Arabidopsis thaliana
  misc_feature: Useful for making plants with altered cell wall content and/or composition
MDMESWKLLRSVCVLSFLLGSCFVYQSLRVVDAQEDPKPAVTLQVDASNGGGRPIPETLFGIFFEEINHAGAGGLWAELVSNRGFEAGGQNTPSNIWPWSIVGDHSSIYVATDRSSCFERNKIALRMDVLCDSKGCPSGGVGVYNPGYWGMNIEEGKKYKVALYVRSTGDIDLSVSLTSSNGSRTLASEKIIASASDVSKWIKKEVLLEAKATDPSARLQLTTTKKGSIWIDQVSAMPVDTHKGHGFRNDLFQMMADIKPRFIRFPGGCFVEGEWLSNAFRWKETVGPWEERPGHFGDVWKYWTDDGLGHFEFFQMAEDIGAAPIWVFNNGISHNDEVETASIMPFVQEALDGIEFARGDANSTWGSVRAKMGRQEPFELKYVAIGNEDCGKTYYRGNYIVFYDAIKKAYPDIKIISNCDGSSHPLDHPADYYDYHIYTSASNLFSMYHQFDRTSRKGPKAFVSEYAVTGKDAGTGSLLASLAEAAFLIGLEKNSDIVEMASYAPLFVNTNDRRWNPDAIVFNSSHLYGTPSYWVQRFFAESSGATLLTSTLKGNSTSLVASAISWKNNGKDYIRIKAVNFGANSENMQVLVTGLDPNVMRVSGSKKTVLTSTNVMDENSFSQPEKVVPHESLLELAEEDMTVVLPPHSFSSFDLLKESAKIRMPISDSSSHQKTTTV

SEQ ID NO: 51314 - protein, 107 aa, Arabidopsis thaliana; identical to SEQ ID NO: 9180
  misc_feature: Useful for making plants with altered lignin content
  misc_feature (92)..(92): Xaa is any aa, unknown, or other

SEQ ID NO: 51315 - protein, 1122 aa, Arabidopsis thaliana
  misc_feature: Useful for making plants with modulated biomass
  misc_feature: Useful for making plants with modulated light quality response
  misc_feature: Useful for making plants with modulated light quality sensitivity
MSGSRPTQSSEGSRRSRHSARIIAQTTVDAKLHADFEESGSSFDYSTSVRVTGPVVENQPPRSDKVTTTYLHHIQKGKLIQPFGCLLALDEKTFKVIAYSENASELLTMASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPEKVSFAFFTRGGKYVECLLCVSKKLDREGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 51316 - protein, 128 aa, Arabidopsis thaliana; identical to SEQ ID NO: 9498
  misc_feature: Useful for making plants with altered terpenoid content

SEQ ID NO: 51317 - protein, 122 aa, Zea mays; identical to SEQ ID NO: 9361
  misc_feature: Useful for making plants with altered alkaloid content

SEQ ID NO: 51318 - protein, 765 aa, Arabidopsis thaliana
  misc_feature: Useful for making plants with altered cell wall content and/or composition
MASHIVGYPRMGPKRELKFALESFWDGKSTAEDLQKVSADLRSSIWKQMSAAGTKFIPSNTFAHYDQVLDTTAMLGAVPPRYGYTGGEIGLDVYFSMARGNASVPAMEMTKWFDTNYHYIVPELGPEVNFSYASHKAVNEYKEAKALGVDTVPVLVGPVSYLLLSKAAKGVDKSFELLSLLPKILPIYKEVITELKAAGATWIQLDEPVLVMDLEGQKLQAFTGAYAELESTLSGLNVLVETYFADIPAEAYKTLTSLKGVTAFGFDLVRGTKTLDLVKAGFPEGKYLFAGVVDGRNIWANDFAASLSTLQALEGIVGKDKLVVSTSCSLLHTAVDLINETKLDDEIKSWLAFAAQKVVEVNALAKALAGQKDEALFSANAAALASRRSSPRVTNEGVQKAAAALKGSDHRRATNVSARLDAQQKKLNLPILPTTTIGSFPQTVELRRVRREYKAKKVSEEDYVKAIKEEIKKVVDLQEELDIDVLVHGEPERNDMVEYFGEQLSGFAFTANGWVQSYGSRCVKPPVIYGDVSRPKAMTVFWSAMAQSMTSRPMKGMLTGPVTILNWSFVRNDQPRHETCYQIALAIKDEVEDLEKGGIGVIQIDEAALREGLPLRKSEHAFYLDWAVHSFRITNCGVQDSTQIHTHMCYSHFNDIIHSIIDMDADVITIENSRSDEKLLSVFREGVKYGAGIGPGVYDIHSPRIPSSEEIADRVNKMLAVLEQNILWVNPDCGLKTRKYTEVKPALKNMVDAAKLIRSQLASAK

SEQ ID NO: 51319 - protein, 919 aa, Panicum virgatum; identical to SEQ ID NO: 2214
  misc_feature: Useful for making plants with altered carbohydrate content

SEQ ID NO: 51320 - protein, 586 aa, Panicum virgatum; identical to SEQ ID NO: 3210
  misc_feature: Useful for making plants with altered carbohydrate content

SEQ ID NO: 51321 - protein, 584 aa, Arabidopsis thaliana
  misc_feature: Useful for making plants with modulated biomass
MTKEVCSNIGLWLLLTLLIGNYVVNLEASHHVYKRLTQSTNTKSPSVNQPYRTGFHFQPPKNWMNDPNGPMIYKGIYHLFYQWNPKGAVWGNIVWAHSTSTDLINWDPHPPAIFPSAPFDINGCWSGSATILPNGKPVILYTGIDPKNQQVQNIAEPKNLSDPYLREWKKSPLNPLMAPDAVNGINASSFRDPTTAWLGQDKKWRVIIGSKIHRRGLAITYTSKDFLKWEKSPEPLHYDDGSGMWECPDFFPVTRFGSNGVETSSFGEPNEILKHVLKISLDDTKHDYYTIGTYDRVKDKFVPDNGFKMDGTAPRYDYGKYYASKTFFDSAKNRRILWGWTNESSSVEDDVEKGWSGIQTIPRKIWLDRSGKQLIQWPVREVERLRTKQVKNLRNKVLKSGSRLEVYGVTAAQADVEVLFKVRDLEKADVIEPSWTDPQLICSKMNVSVKSGLGPFGLMVLASKNLEEYTSVYFRIFKARQNSNKYVVLMCSDQSRSSLKEDNDKTTYGAFVDINPHQPLSLRALIDHSVVESFGGKGRACITSRVYPKLAIGKSSHLFAFNYGYQSVDVLNLNAWSMNSAQIS

SEQ ID NO: 51322 - protein, 501 aa, Panicum virgatum; identical to SEQ ID NO: 29757
  misc_feature: Useful for making plants with altered carbohydrate content

SEQ ID NO: 51323 - protein, 516 aa, Arabidopsis thaliana
  misc_feature: Useful for biocontainment applications
  misc_feature: Useful for making plants with altered cell wall content and/or composition
  misc_feature: Useful for making plants with modulated nitrogen use efficiency
MALLLVSSSSSYALRVTIFLSFFFFLCNGFSYPTTSSLFNTHHHRHHLAKHNYKDALTKSILFFEGQRSGKLPSNQRMSWRRDSGLSDGSALHVDLVGGYYDAGDNIKFGFPMAFTTTMLSWSVIEFGGLMKSELQNAKIAIRWATDYLLKATSQPDTIYVQVGDANKDHSCWERPEDMDTVRSVFKVDKNTPGSDVAAETAAALAAAAIVFRKSDPSYSKVLLKRAISVFAFADKYRGTYSAGLKPDVCPFYCSYSGYQDELLWGAAWLQNATKNLKYLNYIKINGQILGAAEYDNTFGWDNKHAGARILLTKAFLVQNVKTLHEYKGHADNFICSVIPGAPFSSTQYTPGGLLFKMADANMQYVTSTSFLLLTYAKYLTSAKTVVHCGGSVYTPGRLRSIAKRQVDYLLGDNPLRMSYMVGYGPKFPRRIHHRGSSLPCVASHPAKIQCHQGFAIMNSQSPNPNFLVGVVVGGPDQHDRFPDERSDYEQSEPATYINSPLVGALAYFAHAYGQL

SEQ ID NO: 51324 - protein, 636 aa, Arabidopsis thaliana
  misc_feature: Useful for making plants with altered cell wall content and/or composition
MGLNFREKAWILLGILCCSSLICSVKAIVTYDRKAVIINGQRRILLSGSIHYPRSTPEMWPDLIQKAKDGGLDVIQTYVFWNGHEPSPGQYYFEDRYDLVKFIKVVQQAGLYVHLRIGPYVCAEWNFGGFPVWLKYVPGMVFRTDNEPFKAAMQKFTEKIVRMMKEEKLFETQGGPIILSQIENEYGPIEWEIGAPGKAYTKWVAEMAQGLSTGVPWIMCKQDDAPNSIINTCNGFYCENFKPNSDNKPKMWTENWTGWFTEFGGAVPYRPAEDIALSVARFIQNGGSFINYYMYHGGTNFDRTAGEFIATSYDYDAPLDEYGLPREPKYSHLKRLHKVIKLCEPALVSADPTVTSLGDKQEAHVFKSKSSCAAFLSNYNTSSAARVLFGGSTYDLPPWSVSILPDCKTEYYNTAKVRTSSIHMKMVPTNTPFSWGSYNEEIPSANDNGTFSQDGLVEQISITRDKTDYFWYLTDITISPDEKFLTGEDPLLTIGSAGHALHVFVNGQLAGTAYGSLEKPKLTFSQKIKLHAGVNKLALLSTAAGLPNVGVHYETWNTGVLGPVTLNGVNSGTWDMTKWKWSYKIGTKGEALSVHTLAGSSTVEWKEGSLVAKKQPLTWYKVRETEESMNHDHQQS

SEQ ID NO: 51325 - protein, 264 aa, Arabidopsis thaliana
  misc_feature: Useful for making plants with modulated nitrogen use efficiency
MVERARIAKVPLPEAALNCPRCDSTNTKFCYFNNYSLTQPRHFCKTCRRYWTRGGSLRNVPVGGGFRRNKRSKSRSKSTVVVSTDNTTSTSSLTSRPSYSNPSKFHSYGQIPEFNSNLPILPPLQSLGDYNSSNTGLDFGGTQISNMISGMSSSGGILDAWRIPPSQQAQQFPFLINTTGLVQSSNALYPLLEGGVSATQTRNVKAEENDQDRGRDGDGVNNLSRNFLGNININSGRNEEYTSWGGNSSWTGFTSNNSTGHLSF

SEQ ID NO: 51326 - protein, 204 aa, Arabidopsis thaliana
  misc_feature: Useful for making plants with altered alkaloid content
  misc_feature: Useful for making plants with modulated nitrogen use efficiency
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 51327 - protein, 150 aa, Arabidopsis thaliana
  misc_feature: Useful for making plants with altered cell wall content and/or composition
MLKVVLLMMIMMLASQSEAQLNRDFYKESCPSLFLVVRRVVKRAVAREPRMGASLLRLFFHDCFVNGCDGSLLLDDTPSFLGEKTSGPSNNSVRGFEVIDKIKFKVEKMCPGIVSCADILAITARDSVLLVSTSTLLLFVMSYIDACNNC

SEQ ID NO: 51328 - protein, 536 aa, Arabidopsis thaliana
  misc_feature: Useful for making plants with altered cell wall content and/or composition
MRRRGGDSFRRAGRRKISNVVWWVLSGIALLLFFLILSKAGHIEPRPSIPKRRYRNDKFVEGMNMTEEMLSPTSVARQVNDQIALAKAFVVIAKESKNLQFAWDLSAQIRNSQLLLSSAATRRSPLTVLESESTIRDMAVLLYQAQQLHYDSATMIMRLKASIQALEEQMSSVSEKSSKYGQIAAEEVPKSLYCLGVRLTTEWFQNLDLQRTLKERSRVDSKLTDNSLYHFCVFSDNIIATSVVVNSTALNSKAPEKVVFHLVTNEINYAAMKAWFAINMDNLRGVTVEVQKFEDFSWLNASYVPVLKQLQDSDTQSYYFSGHNDDGRTPIKFRNPKYLSMLNHLRFYIPEVFPALKKVVFLDDDVVVQKDLSSLFSIDLNKNVNGAVETCMETFHRYHKYLNYSHPLIRSHFDPDACGWAFGMNVFDLVEWRKRNVTGIYHYWQEKNVDRTLWKLGTLPPGLLTFYGLTEALEASWHILGLGYTNVDARVIEKGAVLHFNGNLKPWLKIGIEKYKPLWERYVDYTSPFMQQCNFH

SEQ ID NO: 51329 - protein, 395 aa, Zea mays
  misc_feature: Useful for making plants with altered lignin content
  misc_feature: Useful for making plants with modulated drought sensitivity
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLSTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 51330 - protein, 205 aa, Arabidopsis thaliana
  misc_feature: Useful for biocontainment applications
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYSTLSPFPFFF

SEQ ID NO: 51331 - protein, 581 aa, Arabidopsis thaliana
  misc_feature: Useful for making plants with modulated flowering time
MNSMNNWLGFSLSPHDQNHHRTDVDSSTTRTAVDVAGGYCFDLAAPSDESSAVQTSFLSPFGVTLEAFTRDNNSHSRDWDINGGACNNINNNEQNGPKLENFLGRTTTIYNTNETVVDGNGDCGGGDGGGGGSLGLSMIKTWLSNHSVANANHQDNGNGARGLSLSMNSSTSDSNNYNNNDDVVQEKTIVDVVETTPKKTIESFGQRTSIYRGVTRHRWTGRYEAHLWDNSCKREGQTRKGRQGGYDKEEKAARAYDLAALKYWGTTTTTNFPLSEYEKEVEEMKHMTRQEYVASLRRKSSGFSRGASIYRGVTRHHQHGRWQARIGRVAGNKDLYLGTFGTQEEAAEAYDIAAIKFRGLSAVTNFDMNRYNVKAILESPSLPIGSSAKRLKDVNNPVPAMMISNNVSESANNVSGWQNTAFQHHQGMDLSLLQQQQERYVGYYNGGNLSTESTRVCFKQEEEQQHFLRNSPSHMTNVDHHSSTSDDSVTVCGNVVSYGGYQGFAIPVGTSVNYDPFTAAEIAYNARNHYYYAQHQQQQQIQQSPGGDFPVAISNNHSSNMYFHGEGGGEGAPTFSVWNDT

SEQ ID NO: 51332 - protein, 555 aa, Arabidopsis thaliana
  misc_feature: Useful for making plants with altered lignin content
  misc_feature: Useful for making plants with modulated biomass
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 51333 - protein, 714 aa, Populus balsamifera subsp. trichocarpa
  misc_feature: Useful for making plants with modulated asexual embryo production
MASMNNWLGFSLSHQELPSSQSDHHQDHSQNTDSRLGFHSDEISGTNVSGECFDLTSDSTAPSLNLPATFGILEAFRNNQPQDWNMKSLGMNPDTNYKTASGLPIFMGTSCNSQTIDQNQEPKLENFLGGHSFGNHEHKLNGCNTMYDTTGDYVFQNCSLQLPSEATSNERTSNNGGGDNKNSSIGLSMIKTWLRNQPAPTQQDTNNKNNGGAQSLSLSMSTGSQSAASALPLLAVNGGVNNTGGDQSSSDNNKQQKSTTPSLDSQTGAVESVPRKSIDTFGQRTSIYRGVTRHRWTGRYEAHLWDNSCRREGQTRKGRQGGYDKEEKAARAYDLAALKYWGTTTTTNFPITNYEKEIEEMKHMTRQEYVASLRRKSSGFSRGASIYRGVTRYHGRWQARIGRVAGNKDLYLGTFSTQEEAAEAYDIAAIKFRGLNAVTNFDMSRYDVNSILESSTLPIGGAAKRLKEAEHAEIAMDIAQRTDDHDNMGSQLTDGISSYGAVQHGWPTVAFQQAQPFSMHYPYGQRLWCKQEQDSDNRSFQELHQLQLGNTHNFFQPSVLHNLVSMDSSSMEHSSGSNSVVYSSGVNDGTSTGTNGGYQGIGYGSSAGYAVPMATVISNNDNNHNQGNGYGDGDQVKALGYENMFSPSDPYHARNLHYLSQQPSAGGIKASAYDQGSACYNWVPTAVPTIAAARSNNMAVCHGAQPFTVWNDGT

SEQ ID NO: 51334 - protein, 500 aa, Panicum virgatum; identical to SEQ ID NO: 30224
  misc_feature: Useful for making plants with altered carbohydrate content

SEQ ID NO: 51335 - protein, 500 aa, Panicum virgatum; identical to SEQ ID NO: 5678
  misc_feature: Useful for making plants with altered carbohydrate content

SEQ ID NO: 51336 - protein, 502 aa, Arabidopsis thaliana
  misc_feature: Useful for making plants with modulated heat sensitivity
MAMIIGLLEIFIAFIFFFVYQCFSLHKKTPKHMVMNWPVLGMLPGVLFQIPRIYDFVTEALEAENMTGCFIGPWLSGTDILLTVDPVNIQYILSSNFVNYPKGKKFNKIFEFLGDGIFNVDSGLWEDMRNSSHAIFSHQDFQSFSVSTSVSKLSQGLVPILDNAVEKHILVDLQDLFQRFLFDTSSTLMAGYDPKSLSVEMPKVEFADAMDGVADAMFYRHLKPAFLWSIQSWIGVGIEKKMRRGLDVFDQMLGKIISAKREEIKNHGIHDSKGEAMDVLTYYMTIDTTKYKHLKPSNDKFIRDTILGLVIAARDTTSSALTWFFWLLSKNPEAMTKIRQEINKKMPKFDPADLDKLVYLDGAVCETLRLYPSVPFNHKSPAKPDVLPSGHKVDKNWRVVIPIYSLGRMKSVWGDDAEDFRPERWISDSGMLRQESSYKFLAFNAGPRTCLGKRLTFLQMKTVAVEIIRNYDIKVVEGHKPKPVPSVLLRMQHGLKVSVTKI

SEQ ID NO: 51337 - protein, 240 aa, Zea mays; identical to SEQ ID NO: 9483
  misc_feature: Useful for making plants with modulated nitrogen use efficiency

SEQ ID NO: 51338 - protein, 294 aa, Arabidopsis thaliana; identical to SEQ ID NO: 9552
  misc_feature: Useful for making plants with altered alkaloid content

SEQ ID NO: 51339 - protein, 367 aa, Arabidopsis thaliana
  misc_feature: Useful for making plants with altered cell wall content and/or composition
  misc_feature: Useful for making plants with altered lignin content
MGHLIPQTGDEETELGLAAVRLANCAAFPMVFKAAIELGVIDTLYLAARDDVTGSSSFLTPSEIAIRLPTKPSNPEAPALLDRILRLLASYSMVKCQIIDGNRVYKAEPICRYFLKDNVDEELGTLASQLIVTLDTVFLNTWGELKNVVLEGGVAFGRANGGLKLFDYISKDERLSKLFNRTGFSVAVLKKILQVYSGFEGVNVLVDVGGGVGDTLGFVTSKYPNIKGINFDLTCALTQAPSYPNVEHVAGDMFVDVPKGDAILLKRILHDWTDEDCEKILKNCWKALPENGKVIVMEVVTPDEADNRDVISNIAFDMDLLMLTQLSGGKERSRAEYVAMAANSGFPRCNFVCSAYHLWVIELTKQA

SEQ ID NO: 51340 - protein, 197 aa, Arabidopsis thaliana
  misc_feature: Useful for making plants with modulated light quality sensitivity
MDLSPVKEALAAKSFDKIADICDTLMLQVASEGIEYHDDWPYAIHLLGYFYVDDCDSARFLWKRIPTAIKERKPEVVAAWGIGQKLWTHDYAGVYEAIRGYDWSQEAKDMVAAFSDLYTKRMFQLLLSAYSTITIHDLALFLGMTEDDATTYVVENGWTVDAASQMASVKKQAVKREQKVDSSKLQRLTEYVFHLEH

SEQ ID NO: 51341 - protein, 251 aa, Arabidopsis thaliana; identical to SEQ ID NO: 9460
  misc_feature: Useful for making plants with modulated low light sensitivity

SEQ ID NO: 51342 - protein, 507 aa, Arabidopsis thaliana
  misc_feature: Useful for making plants with altered cell wall content and/or composition
MRTIYLSLLVFIIVLALNEVMAKKHSSTPKLRRSDFPEDFIFGAATSAYQVEGAAHEDGRGPSIWDTFSEKYPEKIKDGSNGSIASDSYHLYKEDVGLLHQIGFDAYRFSISWSRILPRENLKGGINQAGIDYYNNLINELLSKGIKPFATIFHWDTPQSLEDAYGGFLGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYSESAEDRLAAARAMAFTFDYFMEPLVTGKYPIDMVNYVKGGRLPTFTAKQSKMLKGSYDFIGRNYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYAVRFGLVYVDFNGGRKRYPKKSAKWFKKLLNEKKKN

SEQ ID NO: 51343 - protein, 300 aa, Arabidopsis thaliana; identical to SEQ ID NO: 9511
  misc_feature: Useful for making plants with altered alkaloid content
  misc_feature (135)..(135): Xaa is any aa, unknown, or other

SEQ ID NO: 51344 - protein, 554 aa, Panicum virgatum; identical to SEQ ID NO: 3458
  misc_feature: Useful for making plants with altered carbohydrate content

SEQ ID NO: 51345 - protein, 525 aa, Arabidopsis thaliana; identical to SEQ ID NO: 9633
  misc_feature: Useful for making plants with altered cell wall content and/or composition
  misc_feature: Useful for making plants with altered lignin content

SEQ ID NO: 51346 - protein, 638 aa, Arabidopsis thaliana; identical to SEQ ID NO: 9752
  misc_feature: Useful for making plants with modulated biomass

SEQ ID NO: 51347 - protein, 483 aa, Arabidopsis thaliana; identical to SEQ ID NO: 9721
  misc_feature: Useful for making plants with altered terpenoid content
  misc_feature: Useful for making plants with modulated nitrogen use efficiency

SEQ ID NO: 51348 - protein, 546 aa, Arabidopsis thaliana
  misc_feature: Useful for making plants with altered cell wall content and/or composition
MASVNSRSGFCNSNSTFYSKRTPIPLPPNPSLDVTTFISSQAHRGRIAFIDASTGQNLTFTELWRAVESVADCLSEIGIRKGHVVLLLSPNSILFPVVCLSVMSLGAIITTTNPLNTSNEIAKQIKDSNPVLAFTTSQLLPKISAAAKKLPIVLMDEERVDSVGDVRRLVEMMKKEPSGNRVKERVDQDDTATLLYSSGTTGMSKGVISSHRNLIAMVQTIVNRFGSDDGEQRFICTVPMFHIYGLAAFATGLLAYGSTIIVLSKFEMHEMMSAIGKYQATSLPLVPPILVAMVNGADQIKAKYDLSSMHTVLCGGAPLSKEVTEGFAEKYPTVKILQGYGLTESTGIGASTDTVEESRRYGTAGKLSASMEGRIVDPVTGQILGPKQTGELWLKGPSIMKGYFSNEEATSSTLDSEGWLRTGDLCYIDEDGFIFVVDRLKELIKYKGYQVAPAELEALLLTHPEITDAAVIPFPDKEVGQFPMAYVVRKTGSSLSEKTIMEFVAKQVAPYKRIRKVAFVSSIPKNPSGKILRKDLIKIATSNSKL

SEQ ID NO: 51349 - protein, 431 aa, Arabidopsis thaliana
  misc_feature: Useful for making plants with modulated water use efficiency
MGTHINFNNLGGGGHPGGEGSSNQMKPTGSVMPLARQSSVYSLTFDELQNTLGGPGKDFGSMNMDELLKSIWTAEEAQAMAMTSAPAATAVAQPGAGIPPPGGNLQRQGSLTLPRTISQKTVDEVWKCLITKDGNMEGSSGGGGESNVPPGRQQTLGEMTLEEFLFRAGVVREDNCVQQMGQVNGNNNNGFYGNSTAAGGLGFGFGQPNQNSITFNGTNDSMILNQPPGLGLKMGGTMQQQQQQQQLLQQQQQQMQQLNQPHPQQRLPQTIFPKQANVAFSAPVNITNKGFAGAANNSINNNNGLASYGGTGVTVAATSPGTSSAENNSLSPVPYVLNRGRRSNTGLEKVIERRQRRMIKNRESAARSRARKQAYTLELEAEIEKLKKTNQELQKKQAEMVEMQKNELKETSKRPWGSKRQCLRRTLTGPW

SEQ ID NO: 51350 - protein, 873 aa, Arabidopsis thaliana; identical to SEQ ID NO: 9422
  misc_feature: Useful for making plants with modulated drought sensitivity

SEQ ID NO: 51351 - protein, 364 aa, Panicum virgatum; identical to SEQ ID NO: 7236
  misc_feature: Useful for making plants with altered carbohydrate content

SEQ ID NO: 51352 - protein, 338 aa, Arabidopsis thaliana
  misc_feature: Useful for making plants with altered cell wall content and/or composition
SSIFFFLFLTSTILISPVQPTTSKPPAPRPHRELSADYYSKKCPQLETLVGSVTSQRFKEVPISAPATIRLFFHDCFVEGCDGSILIETKKGSKKLAEREAYENKELREEGFDSIIKAKALVESHCPSLVSCSDILAIAARDFIHLAGGPYYQVKKGRWDGKRSTAKNVPPNIPRSNSTVDQLIKLFASKGLTVEELVVLSGSHTIGFAHCKNFLGRLYDYKGTKRPDPSLDQRLLKELRMSCPFSGGSSGVVLPLDATTPFVFDNGYFTGLGTNMGLLGSDQALFLDPRTKPIALEMARDKQKFLKAFGDAMDKMGSIGVKRGKRHGEIRTDCRVFL

SEQ ID NO: 51353 - protein, 462 aa, Arabidopsis thaliana
  misc_feature: Useful for making plants with modulated biomass
  misc_feature: Useful for making plants with modulated flowering time
MAPAQNQITSKHVAVIGAGPAGLITSRELRREGHSVVVFEREKQVGGLWVYTPKSDSDPLSLDPTRSKVHSSIYESLRTNVPRESMGVRDFPFLPRFDDESRDARRYPNHREVLAYIQDFAREFKIEEMIRFETEVVRVEPVDNGNWRVQSKNSGGFLEDEIYDAVVVCNGHYTEPNIAHIPGIKSWPGKQIHSHNYRVPDPFENEVVVVIGNFASGADISRDIAKVAKEVHIASRAREPHTYEKISVPQNNLWMHSEIDTTHEDGSIVFKNGKVIFADSIVYCTGYKYNFPFLETNGYLRIDEKRVEPLYKHVFPPALAPGLAFVGLPAMGIVFVMFEIQSKWVAAVLSGRVTLPSTDKMMEDINAWYASLDALGIPKRHTHTIGRIQSEYLNWVAKESGCELVERWRGQEVDGGYLRLVAHPETYRDEWDDDELIEEAYNDFSRKKLISVDPSYYLENGR

SEQ ID NO: 51354 - protein, 356 aa, Arabidopsis thaliana
  misc_feature: Useful for making plants with altered cell wall content and/or composition
PETEHPNKVFGWGARDKSGVLSPFHFSRRDNGENDVTVKILFCGVCHTDLHTIKNDWGYSYYPVVPGHEIVGIATKVGKNVTKFKEGDRVGVGVISGSCQSCESCDQDLENYCPQMSFTYNAIGSDGTKNYGGYSENIVVDQRFVLRFPENLPSDSGAPLLCAGITVYSPMKYYGMTEAGKHLGVAGLGGLGHVAVKIGKAFGLKVTVISSSSTKAEEAINHLGADSFLVTTDPQKMKAAIGTMDYIIDTISAVHALYPLLGLLKVNGKLIALGLPEKPLELPMFPLVLGRKMVGGSDVGGMKETQEMLDFCAKHNITADIELIKMDEINTAMERLAKSDVRYRFVIDVANSLSPP

SEQ ID NO: 51355 - protein, 449 aa, Panicum virgatum; identical to SEQ ID NO: 3036
  misc_feature: Useful for making plants with altered carbohydrate content

SEQ ID NO: 51356 - protein, 456 aa, Arabidopsis thaliana
  misc_feature: Useful for making plants with altered cell wall content and/or composition
MESFFSRSTSIVSKLSFLALWIVFLISSSSFTSTEAYDALDPEGNITMKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 51357 - protein, 172 aa, Arabidopsis thaliana
  misc_feature: Useful for making plants with altered alkaloid content
  misc_feature: Useful for making plants with altered lignin content
  misc_feature: Useful for making plants with modulated flowering time
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 51358 - protein, 286 aa, Arabidopsis thaliana
  misc_feature: Useful for making plants with modulated heat sensitivity
MAAYYRWKSFEENEDRPEKPRRYGVTEMRGPHYSVLSQNLLQEIFESMGQFVDGLKFSGGSNSLIPKSFIKQAIEMAHEHGVYVSTGDWAEHMLRSGPSAFKDYVEECKQLGFDTIELNANLLEVPEETLLRYVRLIKNGGLRAKPMFAVKFNKSDIPGRNRAFGSYVVPEPRSSEFVEDIDLLIRKAERCLEAGADTIMIDADDVCKYADSLRADIIAKVIGRLGIEKTMFEASDAKLVEWFIKRYGPNVNLYVDHSQIMDLECLRGRHLGKDHQSVLSSSYFLF

SEQ ID NO: 51359 - protein, 488 aa, Arabidopsis thaliana
  misc_feature: Useful for making plants with altered cell wall content and/or composition
MRRIAAGIHRLGIRHGDVVMLLLPNSPEFALSFLAVAYLGAVSTTANPFYTQPEIAKQAKASAAKMIITKKCLVDKLTNLKNDGVLIVCLDDDGDNGVVSSSDDGCVSFTELTQADETELLKPKISPEDTVAMPYSSGTTGLPKGVMITHKGLVTSIAQKVDGENPNLNFTANDVILCFLPMFHIYALDALMLSAMRTGAALLIVPRFELNLVMELIQRYKVTVVPVAPPVVLAFIKSPETERYDLSSVRIMLSGAATLKKELEDAVRLKFPNAIFGQGYGMTESGTVAKSLAFAKNPFKTKSGACGTVIRNAEMKVVDTETGISLPRNKSGEICVRGHQLMKGYLNDPEATARTIDKDGWLHTGDIGFVDDDDEIFIVDRLKELIKFKGYQVAPAELEALLISHPSIDDAAVVAMKDEVADEVPVAFVARSQGSQLTEDDVKSYVNKQVVHYKRIKMVFFIEVIPKAVSGKILRKDLRAKLETMCSK

SEQ ID NO: 51360 - protein, 445 aa, Arabidopsis thaliana
  misc_feature: Useful for making plants with modulated flowering time
MKGASGAVKKKPQVLNEAGEAETAVETVGESRKISGDGGFGSDDGGGGGGGGSGESILREIGDDRPTEDGDEEEEEDEDEDDGGDEEDEEGEGEGGQEERPKLDEGFYEIEAIRRKRVRKGKVQYLIKWRGWPETANTWEPLENLQSIADVIDAFEGSLKPGKPGRKRKRKYAGPHSQMKKKQRLTSTSHDATEKSDSSTSLNNSSLPDIPDPLDLSGSSLLNRDVEAKNAYVSNQVEANSGSVGMARQVRLIDNEKEYDPTLNELRGPVNNSNGAGCSQGGGIGSEGDNVRPNGLLKVYPKELDKNSRFIGAKRRKSGSVKRFKQDGSTSNNHTAPTDQNLTPDLTTLDSFGRIARMGNEYPGVMENCNLSQKTKIEELDITKILKPMSFTASVSDNVQEVLVTFLALRSDGKEALVDNRFLKAHNPHLLIEFYEQHLKYNRTP

SEQ ID NO: 51361 - protein, 210 aa, Panicum virgatum
  misc_feature: Useful for making plants with altered carbohydrate content
MPPLPKRPGPLLVLLVVAFAAATAAAAASDAAGATVPFYPSAEAAAAAHCDGTLYPDVCLSTLADIPDLHKKPLPDVICAAVNRTEDVVAATASNCSSYLRERSLTARDRLALSDCLELLSTSMDELQATVADLESPAATGGGGSASSSSAVGARRVTMDHVMTVLSAAITNQYTCLDGFAYQNGGRVRRYIEPTLHHVSRMVSNSLAMA

SEQ ID NO: 51362 - protein, 301 aa, Zea mays
  misc_feature: Useful for making plants with altered terpenoid content
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 51363 - protein, 264 aa, Arabidopsis thaliana; identical to SEQ ID NO: 9405
  misc_feature: Useful for making plants with modulated biomass
  misc_feature (157)..(157): Xaa is any aa, unknown, or other
  misc_feature (173)..(173): Xaa is any aa, unknown, or other
  misc_feature (174)..(174): Xaa is any aa, unknown, or other
  misc_feature (178)..(178): Xaa is any aa, unknown, or other
  misc_feature (211)..(211): Xaa is any aa, unknown, or other
  misc_feature (212)..(212): Xaa is any aa, unknown, or other
  misc_feature (232)..(232): Xaa is any aa, unknown, or other
  misc_feature (234)..(234): Xaa is any aa, unknown, or other
  misc_feature (260)..(260): Xaa is any aa, unknown, or other

SEQ ID NO: 51364 - protein, 342 aa, Arabidopsis thaliana
  misc_feature: Useful for making plants with altered cell wall content and/or composition
MHAKTDSEVTSLAASSPARSPRRPVYYVQSPSRDSHDGEKTATSFHSTPVLSPMGSPPHSHSSMGRHSRESSSSRFSGSLKPGSRKVNPNDGSKRKGHGGEKQWKECAVIEEEGLLDDGDRDGGVPRRCYVLAFIVGFFILFGFFSLILYGAAKPMKPKITVKSITFETLKIQAGQDAGGVGTDMITMNATLRMLYRNTGTFFGVHVTSTPIDLSFSQIKIGSGSVKKFYQGRKSERTVLVHVIGEKIPLYGSGSTLLPPAPPAPLPKPKKKKGAPVPIPDPPAPPAPVPMTLSFVVRSRAYVLGKLVQPKFYKKIECDINFEHKNLNKHIVITKNCTVTTV

SEQ ID NO: 51365 - protein, 418 aa, Panicum virgatum; identical to SEQ ID NO: 31361
  misc_feature: Useful for making plants with altered carbohydrate content

SEQ ID NO: 51366 - protein, 421 aa, Arabidopsis thaliana
  misc_feature: Useful for making plants with altered cell wall content and/or composition
MAIPKAHYSLAIIVVLFAVSRSQKVEGAAHRALNGWDYFTHRYPERVSDRSIGDLACNSYDLYKDDVKLLKRMNVQAYRFSIAWSRVLPKGRLIGGVDENGITYYNNLINELKANGIEPFVTIFHWDVPQDFRRRIWRLLKPTYSDFKNYAELLFQRFGDRVKFWITLNQPYSLAVKGYGDGQYPPGRCTDCEFGGDSGTEPYIVGHHELLAHMEAVSLYRKRYQKFQGGKIGTTLIGRWFIPLNETNDLDKAAAKREFDFSVLGSTGVRTISKDNERLGDRLPKFTPKQSALLKGSLDFLGLNYYVTRYATYRPPPMPTQHSVLTDSGVTIGFERNGVSIGVKASINFGFRQILNHIKNKYKNPLTYITENGYFAWSLMDNYEFGNGYTLRFDMNWVNFTNPADRREKASGKWFSRFIAK

SEQ ID NO: 51367 - protein, 384 aa, Arabidopsis thaliana
  misc_feature: Useful for making plants with altered lignin content
MEMMSSSSSTTQVVSFRDMGMYEPFQQLSGWESPFKSDINNITSNQNNNQSSSTTLEFDARPEADDNNRVNYTSVYNNSLEAEPSSNNDQDEDRINDKMKRRLAQNREAARKSRLRKKAHVQQLEESRLKLSQLEQELVRARQQGLCVRNSSDTSYLGPAGNMNSGIAAFEMEYTHWLEEQNRRVSEIRTALQAHIGDIELKMLVDSCLNHYANLFRMKADAAKADVFFLMSGMWRTSTERFFQWIGGFRPSELLNVVMPYVEPLTDQQLLEVRNLQQSSQQAEEALSQGLDKLQQGLVESIAIQIKVVESVNHGAPMASAMENLQALESFVNQADHLRQQTLQQMSKILTTRQAARGLLALGEYFHRLRALSSLWAARPREHT

SEQ ID NO: 51368 - protein, 439 aa, Arabidopsis thaliana
  misc_feature: Useful for making plants with modulated light quality sensitivity
MASDADMEDYGFEYSDEEQEEQDVDIENQYYNSKGMVETEPEEALSGFAEVVQMEPEKADWGFKALKQTVKIYYRLGKYKEMMEAYTEMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALAIKSAIPHPRIMGIIRECGGKMHMAERQWEEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRVC

SEQ ID NO: 51369 - protein, 872 aa, Arabidopsis thaliana; identical to SEQ ID NO: 9469
  misc_feature: Useful for making plants with modulated low light sensitivity

SEQ ID NO: 51370 - protein, 767 aa, Arabidopsis thaliana
  misc_feature: Useful for making plants with altered terpenoid content
MDVLALSSSASAAAPSASLAGKFLSFPSRVRVRRNRENLLAKQKKFLVSASKREEPKLNEWDQMELNFGRLLGEDPKLTLAKIVARKVDPEASFIDIEKSFYKNKGKIPEVEEIPLDWSKDNKKKSTSSLDGLKLVKPVLKDGVKFERPVMKKPSPVLKKPLVEAVAAPKVQRLPNVILRKPSSFYTSNGDDEESKLRLKPNLTLKMRNERENERFSDMTLLRKPEPVSVVAEEEDKPLSDDLTMEEGEQEGGTYSQYTLLEKPEARLQPVNVEEEVGDSGGVESSEIVNNSIQKPEARPELENIEKEVADSGVLESSEIENNSIPTEMQLNSEMSSEEKTINSDPLERIPSKPISQTIVEASLQGKPQRLDPSSAEPSVPNIGKPSVVNHEGRQVSVELKGPPTRSSLEENDWNKAESLVKTELRADVELISSSTRGFAVSYGSLIGFLPYRNLAAKWKFLAFESWLRRKGVDPSPYRQNLGVIGGQDVTSKSPSPDSSLDSEVATTINGEVSSDMKLEDLLMVYDREKQKFLSSFVGQKIKVNVVMANRNSRKLIFSMRPRENEEEVEKKRTLMAKLRVGDVVKCCIKKITYFGIFCELEGVPALVHQSEVSWDATLDPASYFKIGQIVEAKVHQLDFALERIFLSLKEITPDPLTEALESVVGGDNDQLGGRLQAAELDAEWPDVESLIKELEMVEGIQSVSKSRFFLSPGLAPTFQVYMAPMFENQYKLLARAGNRVQELIVEASLSKEEMKSTIMSCTNRVE

SEQ ID NO: 51371 - protein, 413 aa, Arabidopsis thaliana
  misc_feature: Useful for making plants with modulated nitrogen use efficiency
MERAAILPSVNQNYLLCPSRAFSTRLHSSTRNLSPPSFASIKLQHSSSSVSSNGGISLTRCNAVSSNSSSTLVPELADIDWDTVGFGLKPADYMYVMKCNIDGEFSKGELQRFGNIEISPSAGVLNYGQGLFEGLKAYRKKDGNNILLFRPEENAKRMRNGAERMCMPAPTVEQFVEAVTETVLANKRWVPPPGKGSLYVRPLLMGTGAVLGLAPAPEYTFIIYVSPVGNYFKEGVAPINLIVENEFHRATPGGTGGVKTIGNYAAVLKAQSIAKAKGYSDVLYLDCIYKRYLEEVSSCNIFIVKDNVISTPEIKGTILPGITRKSMIDVARTQGFQVEERNVTVDELLEADEVFCTGTAVVVSPVGSVTYKGKRVSYGEGTFGTVSKQLYTVLTSLQMGLIEDNMKWTVNLS

SEQ ID NO: 51372 - protein, 354 aa, Arabidopsis thaliana
  misc_feature: Useful for making plants with modulated biomass
  misc_feature: Useful for making plants with modulated flowering time
  misc_feature: Useful for making plants with modulated nitrogen use efficiency
MAPSAQPLPVSVSDEKYANVKWEELAFKFVRTDYMYVAKCNHGESFQEGKILPFADLQLNPCAAVLQYGQGLYEGLKAYRTEDGRILLFRPDQNGLRLQAGADRLYMPYPSVDQFVSAIKQVALANKKWIPPPGKGTLYIRPILFGSGPILGSFPIPETTFTAFACPVGRYHKDNSGLNLKIEDQFRRAFPSGTGGVKSITNYCPVWIPLAEAKKQGFSDILFLDAATGKNIEELFAANVFMLKGNVVSTPTIAGTILPGVTRNCVMELCRDFGYQVEERTIPLVDFLDADEAFCTGTASIVTSIASVTFKDKKTGFKTGEETLAAKLYETLSDIQTGRVEDTKGWTVEIDRQG

SEQ ID NO: 51373 - protein, 403 aa, Arabidopsis thaliana
  misc_feature: Useful for making plants with modulated biomass
MASLGLSFPPAAKTPTYLASSSSTFFSNSSLSVRTSQFRSRNSVFACVKCDMPESLNVGNGNPSIPIINERTLPKFLESARMEKSVNRTNTRLKLFSGTANPALAQEIAWYMGLDLGKVNIKRFADGEIYVQLQESVRGCDVYLVQPTCTPTNENLMELLIMVDACRRASAKKVTAVIPYFGYARADRKTQGRESIAAKLVANLITEAGADRVLACDLHSGQSMGYFDIPVDHVYCQPVILDYLASKSIPSEDLVVVSPDVGGVARARAFAKKLSDAPLAIVDKRRSGHNVAEVMNLIGDVRGKVAIMVDDMIDTAGTIVKGAALLHQEGAREVYACCTHAVFSPPAIERLSGGLLQEVIVTNTLPVAEKNYFPQLTILSVANLLGETIWRVHDDSSVSSIFL

SEQ ID NO: 51374 - protein, 297 aa, Panicum virgatum; identical to SEQ ID NO: 5546
  misc_feature: Useful for making plants with altered carbohydrate content

SEQ ID NO: 51375 - protein, 293 aa, Arabidopsis thaliana
  misc_feature: Useful for making plants with altered cell wall content and/or composition
MGRLSSTLCLTFLILATVAFGVPPKKSINVPFGRNYFPTWAFDHIKYLNGGSEVHLVLDKYTGTGFQSKGSYLFGHFSMHIKMVAGDSAGTVTAFYLSSQNSEHDEIDFEFLGNRTGQPYILQTNVFTGGAGNREQRINLWFDPSKDYHSYSVLWNMYQIVFFVDDVPIRVFKNSKDVGVKFPFNQPMKIYSSLWNADDWATRGGLEKTNWEKAPFVASYRGFHVDGCEASVNAKFCETQGKRWWDQKEFQDLDANQYKRLKWVRKRYTIYNYCTDRVRFPVPPPECRRDRDI

SEQ ID NO: 51376 - protein, 424 aa, Panicum virgatum; identical to SEQ ID NO: 6568
  misc_feature: Useful for making plants with altered carbohydrate content

SEQ ID NO: 51377 - protein, 264 aa, Zea mays
  misc_feature: Useful for making plants with altered terpenoid content
MADPSYWDWMDIEDLVLPVVIFASVTVAPWLVVFIFLYIKQWWRVFRLGGVTTLRRNLSRNCVLCQQSLEAGEKVRTLSCNHEFHYGRSVKCEGIDHWLLMREPINYCPQCRKFPRSVQPWNTLLGGAPSSAPSQEASAAAQQQLPRTSSTRDLEDPLLPGHGETRTSTTLPVDDEIVEEAPSSQSTRAAVETDSATVATTFTKSIGGSATTVAAEVVVDAGFGGPTASEARRETDAEAASVPVDSEIVEEAPSSQYTRVIKLG

SEQ ID NO: 51378 - protein, 512 aa, Panicum virgatum; identical to SEQ ID NO: 848
  misc_feature: Useful for making plants with altered carbohydrate content

SEQ ID NO: 51379 - protein, 593 aa, Arabidopsis thaliana; identical to SEQ ID NO: 9206
  misc_feature: Useful for making plants with altered alkaloid content
  misc_feature: Useful for making plants with altered lignin content

SEQ ID NO: 51380 - protein, 474 aa, Arabidopsis thaliana
  misc_feature: Useful for making plants with altered cell wall content and/or composition
MSHKSKPKPKMKTQPPKSNDGSPVVSQPPQVQQPPPPHVQPPPTPLPLQPVEDSQQFNVLDFGAKGDGMSDDTQAFEAAWASACKVEASTMIIPPDYIFLVGPISFSGPYCQANIVFQLEGMIVAPTDTESWGGGLMWWIEFTKLSGITIQGNGVIDGRGTVWWQQDYLSDYPIDDDFKLIVPLNNSVQERPPMPIRSELNWRMPSIKPTALRFYGSIDVTVTGITIQNSPQCHLKFDNCVKVLVHDVNVSSPGDSPNTDGIHLQNTRDVMIHTTTLACGDDCISIQTGCSNVYVHNVNCGPGHGISIGSLGKDSTKACVSNITVRDVVMHNTMTGVRIKTWQGGIGSVKGILFSNIQLTEVQLPIVIDQFYCDHSKCMNHTSAVSVEGVTYEKIRGTYTVKPVHFACSDSFPCIDVQLSGIELKPVQLQYHMYDPFCWKTFGELNSATVPPIDCLQIGKPARNGVHSDHDICL

SEQ ID NO: 51381 - protein, 390 aa, Arabidopsis thaliana
  misc_feature: Useful for making plants with altered alkaloid content
MSDKDEFAAKKKDLVNTPVDLYPPENPMLGPSPMMDSFRETLWHDGGFNVHTDADTSFRGNNNIDIPLEMGWNMAQFPADSGFIERAAKFSFFGCGEMMMNQQQSSLGVPDSTGLFLQDTQIPSGSKLDNGPLTDASKLVKERSINNVSEDSQSSGGNGHDDAKCGQTSSKGFSSKKRKRIGKDCEEEEDKKQKDEQSPTSNANKTNSEKQPSDSLKDGYIHMRARRGQATNSHSLAERVRREKISERMKFLQDLVPGCDKVTGKAVMLDEIINYVQSLQCQIEFLSMKLSAVNPVLDFNLESLLAKDALQSSAPTFPHNMSMLYPPVSYLSQTGFMQPNISSMLLLSGGLKRQETHGYESDHHNLVHKNHETGTAPDHEDTTADMKVEP

SEQ ID NO: 51382 - protein, 268 aa, Zea mays
  misc_feature: Useful for making plants with altered terpenoid content
MATVGQSGALRRVTVHYANSPTGSTVAEVSFDDLDDELLLFVLADLLPGQEGLHQSILEGTYNNQENHMRGAAPSAPYGYSRPEEYRAESSTAAAAATGSRNSGMDEQIASDFEYAKQLQQEMEDLSVKDEDDNDISCVPSPSDSDDEHEHHDEEEEADRQEDGDGDDGPDNMTYEQGQALVESVGTEYRGLSDELISYLQSWKYKSSGLFSRKTNHEDCPICLSTFRNRETMITLPCRHHYHAACVTRWLKVNKTCPVCKYELFGPS

SEQ ID NO: 51383 - protein, 356 aa, Arabidopsis thaliana
  misc_feature: Useful for making plants with altered alkaloid content
MGSTGNPNPWGTTYDSYRDCSQGVCSVYCPQWCYVIFPPPPSFYLDDEDDSSSSDFSPLLIALIGILASAFILVSYYTLISKYCHRRRHNSSSTSAAAINRISSDYTWQGTNNNNNNGATNPNQTIGGGGGDGLDESLIKSITVYKYRKMDGFVESSDCSVCLSEFQENESLRLLPKCNHAFHVPCIDTWLKSHSNCPLCRAFIVTSSAVEIVDLTNQQIVTENNSISTGDDSVVVVNLDLENSRSRNETVNEGSTPKPPEMQDSRDGEERRSASLNSGGGVVSIADILREIEDDEESAGVGTSRWVEEGEGEKTPPPSGSAANQTNGISNFLVRSSMAAMKRSGYDRAKNYRLPK

SEQ ID NO: 51384 - protein, 492 aa, Panicum virgatum; identical to SEQ ID NO: 8612
  misc_feature: Useful for making plants with altered carbohydrate content

SEQ ID NO: 51385 - protein, 337 aa, Panicum virgatum; identical to SEQ ID NO: 276
  misc_feature: Useful for making plants with altered carbohydrate content

SEQ ID NO: 51386 - protein, 306 aa, Arabidopsis thaliana
  misc_feature: Useful for making plants with altered cell wall content and/or composition
MTTLFLLIALFITTILNPTSGESVGVCYGMMGNNLPSQSDTIALFRQNNIRRVRLYDPNQAALNALRNTGIEVIIGVPNTDLRSLTNPSSARSWLQNNVLNYYPAVSFKYIAVGNEVSPSNGGDVVLPAMRNVYDALRGANLQDRIKVSTAIDMTLIGNSFPPSSGEFRGDVRWYIDPVIGFLTSTNSALLANIYPYFSYVDNPRDISLSYALFTSPSVVVWDGSRGYQNLFDALLDVVYSAVERSGGGSLPVVVSESGWPSNGGNAASFDNARSFLHESCVACEREQRNTEETWKRSGNVFVRYV

SEQ ID NO: 51387 - protein, 482 aa, Panicum virgatum; identical to SEQ ID NO: 4858
  misc_feature: Useful for making plants with altered carbohydrate content

SEQ ID NO: 51388 - protein, 495 aa, Arabidopsis thaliana; identical to SEQ ID NO: 9397
  misc_feature: Useful for making plants with altered sterol content

SEQ ID NO: 51389 - protein, 500 aa, Panicum virgatum; identical to SEQ ID NO: 3644
  misc_feature: Useful for making plants with altered carbohydrate content

SEQ ID NO: 51390 - protein, 1729 aa, Arabidopsis thaliana
  misc_feature: Useful for making plants with modulated endosperm cell number
  misc_feature: Useful for making plants with modulated endosperm cell size
  misc_feature: Useful for making plants with modulated seed quality
MQSIMDSSAVNATEATEQNDGSRQDVLEFDLNKTPQQKPSKRKRKFMPKVVVEGKPKRKPRKPAELPKVVVEGKPKRKPRKAATQEKVKSKETGSAKKKNLKESATKKPANVGDMSNKSPEVTLKSCRKALNFDLENPGDARQGDSESEIVQNSSGANSFSEIRDAIGGTNGSFLDSVSQIDKTNGLGAMNQPLEVSMGNQPDKLSTGAKLARDQQPDLLTRNQQCQFPVATQNTQFPMENQQAWLQMKNQLIGFPFGNQQPRMTIRNQQPCLAMGNQQPMYLIGTPRPALVSGNQQLGGPQGNKRPIFLNHQTCLPAGNQLYGSPTDMHQLVMSTGGQQHGLLIKNQQPGSLIRGQQPCVPLIDQQPATPKGFTHLNQMVATSMSSPGLRPHSQSQVPTTYLHVESVSRILNGTTGTCQRSRAPAYDSLQQDIHQGNKYILSHEISNGNGCKKALPQNSSLPTPIMAKLEEARGSKRQYHRAMGQTEKHDLNLAQQIAQSQDVERHNSSTCVEYLDAAKKTKIQKVVQENLHGMPPEVIEIEDDPTDGARKGKNTASISKGASKGNSSPVKKTAEKEKCIVPKTPAKKGRAGRKKSVPPPAHASEIQLWQPTPPKTPLSRSKPKGKGRKSIQDSGKARGPSGELLCQDSIAEIIYRMQNLYLGDKEREQEQNAMVLYKGDGALVPYESKKRKPRPKVDIDDETTRIWNLLMGKGDEKEGDEEKDKKKEKWWEEERRVFRGRADSFIARMHLVQGDRRFSPWKGSVVDSVIGVFLTQNVSDHLSSSAFMSLAARFPPKLSSSREDERNVRSVVVEDPEGCILNLNEIPSWQEKVQHPSDMEVSGVDSGSKEQLRDCSNSGIERFNFLEKSIQNLEEEVLSSQDSFDPAIFQSCGRVGSCSCSKSDAEFPTTRCETKTVSGTSQSVQTGSPNLSDEICLQGNERPHLYEGSGDVQKQETTNVAQKKPDLEKTMNWKDSVCFGQPRNDTNWQTTPSSSYEQCATRQPHVLDIEDFGMQGEGLGYSWMSISPRVDRVKNKNVPRRFFRQGGSVPREFTGQIIPSTPHELPGMGLSGSSSAVQEHQDDTQHNQQDEMNKASHLQKTFLDLLNSSEECLTRQSSTKQNITDGCLPRDRTAEDVVDPLSNNSSLQNILVESNSSNKEQTAVEYKETNATILREMKGTLADGKKPTSQWDSLRKDVEGNEGRQERNKNNMDSIDYEAIRRASISEISEAIKERGMNNMLAVRIKDFLERIVKDHGGIDLEWLRESPPDKAKDYLLSIRGLGLKSVECVRLLTLHNLAFPVDTNVGRIAVRMGWVPLQPLPESLQLHLLELYPVLESIQKFLWPRLCKLDQRTLYELHYQLITFGKVFCTKSRPNCNACPMRGECRHFASAYASARLALPAPEERSLTSATIPVPPESYPPVAIPMIELPLPLEKSLASGAPSNRENCEPIIEEPASPGQECTEITESDIEDAYYNEDPDEIPTIKLNIEQFGMTLREHMERNMELQEGDMSKALVALHPTTTSIPTPKLKNISRLRTEHQVYELPDSHRLLDGMDKREPDDPSPYLLAIWTPGETANSAQPPEQKCGGKASGKMCFDETCSECNSLREANSQTVRGTLLIPCRTAMRGSFPLNGTYFQVNELFADHESSLKPIDVPRDWIWDLPRRTVYFGTSVTSIFRGLSTEQIQFCFWKGFVCVRGFEQKTRAPRPLMARLHFPASKLKNNKT

SEQ ID NO: 51391 - protein, 481 aa, Arabidopsis thaliana; identical to SEQ ID NO: 9239
  misc_feature: Useful for making plants with modulated nitrogen use efficiency

SEQ ID NO: 51392 - protein, 495 aa, Panicum virgatum; identical to SEQ ID NO: 32150
  misc_feature: Useful for making plants with altered carbohydrate content

SEQ ID NO: 51393 - protein, 550 aa, Arabidopsis thaliana
  misc_feature: Useful for making plants with altered cell wall content and/or composition
MGAKSKSSSTRFFMFYLILISLSFLGLLLNFKPLFLLNPMIASPSIVEIRYSLPEPVKRTPIWLRLIRNYLPDEKKIRVGLLNIAENERESYEASGTSILENVHVSLDPLPNNLTWTSLFPVWIDEDHTWHIPSCPEVPLPKMEGSEADVDVVVVKVPCDGFSEKRGLRDVFRLQVNLAAANLVVESGRRNVDRTVYVVFIGSCGPMHEIFRCDERVKRVGDYWVYRPDLTRLKQKLLMPPGSCQIAPLGQGEAWIQDKNRNLTSEKTTLSSFTAQRVAYVTLLHSSEVYVCGAIALAQSIRQSGSTKDMILLHDDSITNISLIGLSLAGWKLRRVERIRSPFSKKRSYNEWNYSKLRVWQVTDYDKLVFIDADFIIVKNIDYLFSYPQLSAAGNNKVLFNSGVMVLEPSACLFEDLMLKSFKIGSYNGGDQGFLNEYFVWWHRHDKARNLPENLEGIHYLGLKPWRCYRDYDCNWDLKTRRVYASESVHARWWKVYDKMPKKLKGYCGLNLKMEKNVEKWRKMAKLNGFPENHWKIRIKDPRKKNRLSQ

SEQ ID NO: 51394 - protein, 232 aa, Arabidopsis thaliana
  misc_feature: Useful for making plants with altered lignin content
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLNKLDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 51395 - protein, 340 aa, Arabidopsis thaliana
  misc_feature: Useful for making plants with altered cell wall content and/or composition
MDLRFLASLTLLLGLFFVNTNPTGGQVGVCYGRNGNNLPSPAETIALFKQKNIQRVRLYSPDHDVLAALRGSNIEVTLGLPNSYLQSVASSQSQANAWVQTYVMNYANGVRFRYISVGNEVKISDSYAQFLVPAMENIDRAVLAAGLGGRIKVSTSVDMGVLRESYPPSKGSFRGDVMVVMEPIIRFLVSKNSPLLLNLYTYFSYAGNVGQIRLDYALFTAPSGIVSDPPRSYQNLFDAMLDAMYSALEKSGGASLEIVVAETGWPTGGGTDTNIENARIYNNNLIKHVKNGTPKRPGKEIETYLFAIYDENQKPTPPYVEKFWGLFYPNKQPKYDINFY

SEQ ID NO: 51396 - protein, 264 aa, Panicum virgatum
  misc_feature: Useful for making plants with altered carbohydrate content
MDATPTMLGEKDALSNINSLRSFEVVDEIKEALEERCPGVVSCADIVVMAARDAVFLTGGPTWEVRLGREDSLTASQEDSDSIMPSPRANASALIRLFAGLNLSVTDLVALSGSHSIGEARCFSIVFRLYNQSGSGRPDPNMDAGYRRALNALCPRGGDEEVTGGMDATPRVFDNRYFKDLVALRGFLNSDQTLFSDNARTRRVVKRFSEDQDAFFRAFIEGMIKMGELQNPRKREIRRNCRVANGSPSPATPKEVATYRVMDF

SEQ ID NO: 51397 - protein, 268 aa, Arabidopsis thaliana; identical to SEQ ID NO: 9681
  misc_feature: Useful for making plants with modulated time to senescence

SEQ ID NO: 51398 - protein, 268 aa, Arabidopsis thaliana
  misc_feature: Useful for making plants with modulated abscission
  misc_feature (123)..(123): Xaa is any aa, unknown, or other
MCSLSAIMLLPTKLKPAYSDKRSNSSSSSSLFFNNRRSKKKNQSIVPVARLFGPAIFESSKLKVLFLGVDEKKHPSTLPRTYTLTHSDITAKLTLAISQSINNSQLQGWANRLYRDEVVAEWXKVKGKMSLHVHCHISGGHFLLDLFAKFRYFIFCKELPVVLKAFVHGDGNLLNNYPELQEALVWVYFHSNVNEFNKVECWGPLWEAVSPDGHKTETLPEARCADECSCCFPTVSSIPWSHSLSNEGVNGYSGTQTEGIATPNPEKL

SEQ ID NO: 51399 - protein, 346 aa, Panicum virgatum
  misc_feature: Useful for making plants with altered carbohydrate content
MEKRRRCSNLLAVAALALVAAMLPPSGKAKLSPDYYRSTCPDVEAIVRAVVAKKVKETFVTVPATLRLFFHDCFVEGCDASVIIASRDNDAEKDAPDNVSLAGDGFDTVVRAKAEVEKECPGVVSCADILAIAARDVVAMSSGPHWAVELGRLDGLVSKAGGVAGRLPGPDMRVADLAALFARHNLTTLDMVALSGAHTVGFAHCTRFTGRLYRHGAVGAGAHAVDPSYDPAYARQLMAACPPDVGETIAVDMDPVTPTAFDNAYYGNLARGMGLFTSDQALHTDGASRPAVRDFAGNQTRFFEAFKDAMVKLGRVGVKTGRHGEIRRDCTAFNKKIEASSRRLHN

SEQ ID NO: 51400 - protein, 330 aa, Arabidopsis thaliana
  misc_feature: Useful for making plants with altered cell wall content and/or composition
MDIRSDDAKKPMMMWFLGMLLFSMVAESNAQLSENYYASTCPSVELIVKQAVTTKFKQTVTTAPATLRMFFHDCFVEGCDASVFIASENEDAEKDADDNKSLAGDGFDTVIKAKTAVESQCPGVVSCADILALAARDVVVLVGGPEFKVELGRRDGLVSKASRVTGKLPEPGLDVRGLVQIFASNGLSLTDMIALSGAHTIGSSHCNRFANRLHNFSTFMPVDPTMDPVYAQQLIQACSDPNPDAVVDIDLTSRDTFDNSYYQNLVARKGLFTSDQALFNDLSSQATVVRFANNAEEFYSAFSSAMRNLGRVGVKVGNQGEIRRDCSAFN

SEQ ID NO: 51401 - protein, 307 aa, Arabidopsis thaliana; identical to SEQ ID NO: 9571
  misc_feature: Useful for biocontainment applications
  misc_feature: Useful for making plants with modulated biomass

SEQ ID NO: 51402 - protein, 328 aa, Panicum virgatum; identical to SEQ ID NO: 32298
  misc_feature: Useful for making plants with altered carbohydrate content

SEQ ID NO: 51403 - protein, 93 aa, Zea mays; identical to SEQ ID NO: 9484
  misc_feature: Useful for making plants with altered lignin content

SEQ ID NO: 51404 - protein, 81 aa, Arabidopsis thaliana; identical to SEQ ID NO: 9276
  misc_feature: Useful for making plants with altered lignin content
  misc_feature: Useful for making plants with modulated low light sensitivity

SEQ ID NO: 51405 - protein, 101 aa, Arabidopsis thaliana
  misc_feature: Useful for making plants with modulated nitrogen use efficiency
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 51406 - protein, 126 aa, Arabidopsis thaliana
  misc_feature: Useful for making plants with modulated flowering time
MASNSRSSISPWTFSQNKMFERALAVYDKDTPDRWHNVAKAVGGKTVEEVKRHYDILVEDLINIETGRVPLPNYKTFESNSRSINDFDTRYITKYLYMMLSIYFDNHSSDFEKFSQKVLVSYISLV

SEQ ID NO: 51407 - protein, 461 aa, Glycine max
  misc_feature: Useful for making plants with altered alkaloid content
MLDLNLTAESTQNDELLVLLDKFPEASSGTSNSSIVNAEGSSNEDSCSTRAGDVFTFNFGILKVEAANDVVAAATKELFPVSSENWQGQSSTSLFQARKSLMDLSLDQQHGEVKVVQVQPQPKVKKSRRGPRSRSSQYRGVTFYRRTGRWESHIWDCGKQVYLGGFDTAHAAARAYDRAAIKFRGLDADINFNLVDYEEDLKQMKNLSKEEFVHILRRHSSGFSRGSSKYRGVTLHKCGRWEARMGQFLGKKAYDKAAIKCNGREAVTNFEPSTYESEMKPEAINEGGSHDLDLSLGIATPGHGPKENRGHLQFQSIPYNMHPGRSSMMETNINSVIGDPSLKRLVVTEERPSVWNAAYSTFFPNLERAERMGTDPSKGVPNPNWAWQTHGQVTDTPVPPFSTAASSGFSISATFPSTAIFPTKSINSVPHSLCFTSPSTPGSNAPQFYNYYEVKSPQPPS

SEQ ID NO: 51408 - protein, 432 aa, Arabidopsis thaliana; identical to SEQ ID NO: 9346
  misc_feature: Useful for making plants with modulated nitrogen use efficiency
  misc_feature: Useful for making plants with modulated seed size

SEQ ID NO: 51409 - protein, 352 aa, Arabidopsis thaliana
  misc_feature: Useful for making plants with modulated flowering time
MWNLNDSPDHHEESDSRGNPVGHVSNGMSQSATWLPFVLPVTRNFFPAQSMEPGVRWSGFNSVGKSDPSGSGRPEEPEISPPIKKSRRGPRSRSSQYRGVTFYRRTGRWESHIWDCGKQVYLGGFDTAHAAARAYDRAAIKFRGVDADINFDIEDYLDDLKQMGNLTKEEFMHVLRRQSTGFPRGSSKYRGVTLHKCGRWESRLGQFLNKKYVYLGLFDTEIEAARAYDKAAIKCNGKDAVTNFDPKVYEEEEDLSSETTRNGHNLGLSLGESSSEEFRLKSDIASIRSRIRDEERLLGSDLSLAMMTTTVRSEKQQSDGGGNRVVGMAASSGFSPQPSPYRIPRTFHFSRP

SEQ ID NO: 51410 - protein, 1058 aa, Arabidopsis thaliana
  misc_feature: Useful for making plants with altered cell wall content and/or composition
MDPRTRLDYALFQLTPTRTRCDLVIFSGGENEKLASGIFQPFVTHLKSVSDQISKGGYSVTLRPSSVGVPWFTKVTLQRFVRFVTTPEVLERSVTLEKEIEQIEDSIQANAAAIAGEAEGNELGGTWTSQKSTALSKTKGETDGDTVEENSKVGLQRVLENRKAALCKEQAMAYARALVVGFELDYMDDLFSFADAFGASRLREACVNFVDLCKRKNEDRMWVDQITAMQAFPRPELTFMGDSGIVLAGEENDLLNATNVKHGNSMDASSQGSFETGQEGRAQMAMPWPNQFPQYMQNFQGHGYPPPYMFPGMQGQSPYFHGNMQWPVNMGDVESNEKSSKKKKKKKKNKKKSKQDESAEPSDNSSTETESEDGNEGKKQSRKVVIRNINYITSKRNGAKESDSDESGEEEGFVDGDSIKQQVEEAIGSVERRHKSTSHRQRKHKSHNGDDDSSNKETKGNDNWDAFQNLLLKDNDSEPEELLRISSTALNMASEVVRKREPPSDDSFLVAIGNEDWGRETSIEKFNAGENVRIIRKGNNYDEEMLNPGRSDESRSYSQAEMSVHDGKLRTRNEAEEDWFIRNQAGPETDPSLVKTFVGDHFHLNKSSERDVLTDDSFMIHSRVENQVEDSRLRTEIMDLDVYGTTQQENSAPENTPHEPDDLYMVLGREQDVKPTLLPWTPEIDFETNTLAQRTSRIDLITATKASAGEQTLDGKEKKSRGISKGKDAKSRASSRPDPASKAKRPAWGSRAAVSKSKSEMEEERKKRMEELLIQRQKRIAEKSSGGSVSSSLASKKTPTVTKSVKSSIKNEKTPEAAQSKAKPVLRSSTIERLAVARTAPKEPQQKPVIKRTSKPSGYKTEKAQEKKSSKIGQSDAKSVELSRDPSLEIKETVVEDSHSYLSEKQVDALPAVASVDDFKDIKELHSLPSEETARVKNRPNEIIAEKVQDQTKIDDQETVKNTSVSEDKQITTKHYSEDVGEVQASQEKPVSPKKSVTFSETNMEEKYYFSPAVSEIDISTPPATEADHSRKKWNSEETSPKATAKVFRKLLMFGRKK

SEQ ID NO: 51411 - protein, 257 aa, Arabidopsis thaliana
  misc_feature: Useful for making plants with modulated water use efficiency
MASLFKEQAKLSAYRDRRFSGTQEEFDEALRASTTVYIGNVSFYTTEEQLYELFSRAGEIKKIIMGLDKNTKTPCGFCFVLFYSREDTEDAVKYISGTILDDRPIRVDFDWGFQEGRQWGRGRSGGQVRDEYRTDYDPARGYGKLVQKELEAQRQLVDYGTGSLGAYPQAAPTNYGNGRRGGGNYGQGGQNRHGRGGDYHRKRQRDDDRYGRDNSRRNTDHESRRDTDSDMRPEKNPRFRESGDSDDDGEDDRKRRS

SEQ ID NO: 51412 - protein, 315 aa, Glycine max
  misc_feature: Useful for making plants with altered lignin content
MAAGCISFTATRDRCFRFSFSNAGLKSVTTDLGDGTIMHCWAPKAHKDSKLNLLLIHGFGANAMWQWNDFLSPLTRRFNVYVPDLLFFGDSHTTRPDRSEAFQAQCVAALLQAHGLQRTSVVGISYGGFVAYSLAAQFPERVEKVVLCCAGVCLEDKDLDEGMFQVKTVDEAADILLPQTPEKLRQLVQLAFAKPVKTMPTCFLNDYINVMCTDNRQERKELIETLHKDRKLSNLPKITQPTLIIWGEKDLVFPMELAHRLQRHLGENAQLVVIKNAGHALNVEKPKEMYKNLKSFLIDPATPTPTAQKNHSNGS

SEQ ID NO: 51413 - protein, 335 aa, Arabidopsis thaliana
  misc_feature: Useful for making plants with altered cell wall content and/or composition
MAVTNLPTCDGLFIISLIVIVSSIFGTSSAQLNATFYSGTCPNASAIVRSTIQQALQSDTRIGASLIRLHFHDCFVNGCDASILLDDTGSIQSEKNAGPNVNSARGFNVVDNIKTALENACPGVVSCSDVLALASEASVSLAGGPSWTVLLGRRDSLTANLAGANSSIPSPIESLSNITFKFSAVGLNTNDLVALSGAHTFGRARCGVFNNRLFNFSGTGNPDPTLNSTLLSTLQQLCPQNGSASTITNLDLSTPDAFDNNYFANLQSNDGLLQSDQELFSTTGSSTIAIVTSFASNQTLFFQAFAQSMINMGNISPLTGSNGEIRLDCKKVNGS

SEQ ID NO: 51414 - protein, 350 aa, Arabidopsis thaliana
  misc_feature: Useful for making plants with altered cell wall content and/or composition
MANKSLEIRFLFPLVLFLVVKLLCVDGKGFNNNGHKIRKGRWEGKLKMNFYHNSCPGAEDIVRQIVWKKVEANRSLAPKLLRVHYHDCFVRGCDASLLLDSVAGKAVSEKEARPNLSLSGFEIIDEIKYILEKRCPNTVSCADILTLAARDAVSYEFERPLWNVFTGRVDGRVSLATEAARDLPSAGANFTTLQKLFAESDLDVVDLVALSGAHTIGIAHCGVFGRRLLNFTGKGDTDPSLNPSYASFLKSECSDKSLRLNPSAVVGMDPTGPLAFDSGYFVSLLKNKGLFTSDAALLTDPSAAHIASVFQNSGAFLAQFGRSMIKMSSIKVLTLGDQGGEIRKNCRLVN

SEQ ID NO: 51415 - protein, 385 aa, Panicum virgatum; identical to SEQ ID NO: 5426
  misc_feature: Useful for making plants with altered carbohydrate content

SEQ ID NO: 51416 - protein, 346 aa, Arabidopsis thaliana
  misc_feature: Useful for making plants with altered cell wall content and/or composition
MAISKLIPTLVLFVLFSFDVSVAHPGLGFGWGSNSPIGGSFYSNLYPQFYQFSCPQADEIVMTVLEKAIAKEPRMAASLLRLHFHDCFVQGCDASILLDDSATIRSEKNAGPNKNSVRGFQVIDEIKAKLEQACPQTVSCADILALAARGSTILSGGPSWELPLGRRDSRTASLNGANTNIPAPNSTIQNLLTMFQRKGLNEEDLVSLSGGHTIGVARCTTFKQRLYNQNGNNQPDETLERSYYYGLRSICPPTGGDNNISPLDLASPARFDNTYFKLLLWGKGLLTSDEVLLTGNVGKTGALVKAYAEDERLFFQQFAKSMVNMGNIQPLTGFNGEIRKSCHVIN

SEQ ID NO: 51417 - protein, 166 aa, Arabidopsis thaliana
  misc_feature: Useful for making plants with modulated oxidative stress sensitivity
MGLSKTIPLVLLPILMFGVLSNAQLTSDFYSTTCPNVTAIARGLIERASRNDVRLTAKVMRLHFHDCFVNGCDGSVLLDAAPADGVEGEKEAFQNAGSLDGFEVIDDIKTALENVCPGVVSCADILAIAAEICCTGGRAVMGRIARKERWPDSDPCGRSGCTSTRT

SEQ ID NO: 51418 - protein, 228 aa, Zea mays
  misc_feature: Useful for making plants with altered alkaloid content
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 51419 - protein, 240 aa, Arabidopsis thaliana
  misc_feature: Useful for making plants with modulated flowering time
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 51420 - protein, 332 aa, Arabidopsis thaliana
  misc_feature: Useful for making plants with altered lignin content
MPVDGKLVCVTGAGGYIASWIVKLLLERGYTVRGTVRNPTDPKNNHLRELQGAKERLTLHSADLLDYEALCAAIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYEYVKSLQEKGHLPLPQDSNQNEVIIEP

SEQ ID NO: 51421 - protein, 344 aa, Panicum virgatum; identical to SEQ ID NO: 1706
  misc_feature: Useful for making plants with altered carbohydrate content

SEQ ID NO: 51422 - protein, 332 aa, Arabidopsis thaliana
  misc_feature: Useful for making plants with altered cell wall content and/or composition
MTPETHVDMINASEKAPKERAYVTFLAGNGDYVKGVVGLAKGLRKVKSAYPLVVAMLPDVPEEHREILRSQGCIVREIEPVHPPDSQDAYARAYYIINYSKLRIWNFEEYNKMIYLDADIQVFGNIDDLFDMQDGYLHGVLSCFCEKIWSYTPLYSIGYCQYCPEKVVWPAEMESAPPSPYFNAGMFVFEPNPLTYESLLQTLQVTPPTPFAEQDFLNMFFGKVFKPVSPVYNLILSVLWRHPGKVDLESVKVVHYCPPGSKPWRYTGEEPNMDREDVKMLIKKWWDIYNDESLDFKPKSPADLEATVLESTIIASVTEAPLSYSPAAPSAA

SEQ ID NO: 51423 - protein, 514 aa, Arabidopsis thaliana
  misc_feature: Useful for making plants with modulated carbon-nitrogen partitioning
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIVGWVTVTMGPLFYGLHKMNLLRISAEDEMAGMDMTRHGGFAYAYNDEDDVSTKPWGHFAGRVEPTSRSSTPTPTLTV

SEQ ID NO: 51424 - protein, 514 aa, Arabidopsis thaliana
  misc_feature: Useful for making plants with altered carbon content
  misc_feature: Useful for making plants with altered nitrogen content
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGEKLLAAQIVQIIVIIGWVTVTMGPLFYGLHKMNLLRISAEDEMAGMDMTRHGGFAYAYNDEDDVSTKPWGHFAGRVEPTSRSSTPTPTLTV

SEQ ID NO: 51425 - protein, 214 aa, Panicum virgatum; identical to SEQ ID NO: 32872
  misc_feature: Useful for making plants with altered carbohydrate content

SEQ ID NO: 51426 - protein, 175 aa, Arabidopsis thaliana
  misc_feature: Useful for making plants with modulated biomass
MLRTLERYQKCNYGAPEPNVPSREALAELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVKI

SEQ ID NO: 51427 - protein, 109 aa, Arabidopsis thaliana
  misc_feature: Useful for making plants with altered cell wall content and/or composition
LFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 51428 - protein, 396 aa, Panicum virgatum; identical to SEQ ID NO: 33012
  misc_feature: Useful for making plants with altered carbohydrate content
  misc_feature (395)..(395): Xaa is any aa, unknown, or other

SEQ ID NO: 51429 - protein, 447 aa, Arabidopsis thaliana
  misc_feature: Useful for making plants with altered cell wall content and/or composition
MARKSSLLKRAAIAVVSVIAIYVILNASVSRSLPSSSDLPRQLIREDDDDEGRAPIQPRVRVYMYNLPKRFTYGLIEQHSIARGGIKKPVGDVTTLKYPGHQHMHEWYLFSDLNQPEVDRSGSPIVRVSDPADADLFYVPVFSSLSLIVNAGRPVEAGSGYSDEKMQEGLVEWLEGQEWWRRNAGRDHVIPAGDPNALYRILDRVKNAVLLVSDFGRLRPDQGSFVKDVVIPYSHRVNLFNGEIGVEDRNTLLFFMGNRYRKDGGKVRDLLFQVLEKEDDVTIKHGTQSRENRRAATKGMHTSKFCLNPAGDTPSACRLFDSIVSLCVPLIVSDSIELPFEDVIDYRKFSIFVEANAALQPGFLVQMLRKIKTKKILEYQREMKSVRRYFDYDNPNGAVKEIWRQVSHKLPLIKLMSNRDRRLVLRNLTEPNCSCLCTNQTGLITSI

SEQ ID NO: 51430 - protein, 361 aa, Arabidopsis thaliana
  misc_feature: Useful for making plants with altered cell wall content and/or composition
MVEAQSWTTRRMSNPRFDAAATAAPTIVDIPGTPPHSSASSPLKPFFLSSPTVSPTILTAAIIAAWFGSNIGVLLLNKYLLFYYGFRYPIFLTMTHMLSCAAYSSAVINIAGIVPRQHILSRRQFLKILSLSAIFCLSVVCGNTSLRYIPVSFNQAIGATTPFFTAVFSFLITCKTESTEVYLALLPVVSGIVLASNSEPSFHLFGFLICVASTAGRALKSVVQGIILTSESEKLHSMNLLLYMAPMAACILLPFTLYIEGNVLRVLIEKARTDPLIIFLLAGNATVAYLVNLTNFLVTKHTSALTLQVLGNGKAAVAAGVSVLIFRNPVTVMGIAGFGVTIMGVVLYSEARKRSKLLNQK

SEQ ID NO: 51431 - protein, 423 aa, Arabidopsis thaliana
  misc_feature: Useful for making plants with altered cell wall content and/or composition
MIKKCKMKKLLWSWIILFNIHVNGMMMEFDEMEWFTVFNGTKVFQTQNDVFSEAKFPMVGLTLIQSAAAKGAVCLDGSLPGYHLHRGFGSGANNWLVQLEGGGWCDTIRNCVYRKTTRRGSSSYMEKEIPFTGILSDKAADNPDFYNWNRVKVRYCDGGSFSGDSENKAAQLQFRGKRIWLAAMEDLMAKGMRQAKQALLSGCSAGGLAVILRCDDFGKLFPPSTRVKCLSDAGFFLDAIDVSGGRSLRRLYAGVVRLQNLQTNLPQYCVNRLNPTSCFFPQNLINQVKTPLFILNAAYDSWQIQESLAPKSADPSGSWNDCRLNYAKCSASQIQFLQGFRTRMVNLVKGFAMPSKNGVFLNSCFAHCQTERHDTWFAQNSPAIKNKGIAVAVGDWYFERGGAKLIDCAYPCDKTCHNLVFRR

SEQ ID NO: 51432 - protein, 456 aa, Panicum virgatum; identical to SEQ ID NO: 3038
  misc_feature: Useful for making plants with altered carbohydrate content

SEQ ID NO: 51433 - protein, 469 aa, Arabidopsis thaliana
  misc_feature: Useful for making plants with altered cell wall content and/or composition
MIRPTFGLLVFLAIFLFPAIESRSHRNSVTSKIEFSALNCRKHSAILTDFGAVGDGKTSNTKAFRNAISKLSQMATDGGAQLVVPPGKWLTGSFNLTSHFTLFIQRGATILASQDESEWPVIAPLPSYGKGRDGTGTGRFNSLISGTNLTDVVITGNNGTINGQGQYWWDKFKKKQFKITRPYLIEILFSKNIQISNITLIDSPSWNIHPVYCNSVIVKSVTVLAPVTVPNTDGINPDSCTNTLIEDCYIVSGDDCIAVKSGWDQYGIKFGMPTQQLSIRRLTCISPKSAGVALGSEMSGGIKDVRIEDVTLTNTESAIRIKTAVGRGAYVKDIYARRITMKTMKYVFWMSGNYGSHPDEGFDPKALPEITNINYRDMTAENVTMSASLDGIDKDPFTGICISNVTIALAAKAKKMQWNCTDVAGVTSRVTPEPCSLLPEKKAQAKNVDCAFPSDLIPIESVVLKKCFL

SEQ ID NO: 51434 - protein, 221 aa, Arabidopsis thaliana; identical to SEQ ID NO: 9330
  misc_feature: Useful for biocontainment applications

SEQ ID NO: 51435 - protein, 207 aa, Arabidopsis thaliana; identical to SEQ ID NO: 9304
  misc_feature: Useful for making plants with modulated biomass
  misc_feature: Useful for making plants with modulated flowering time

SEQ ID NO: 51436 - protein, 316 aa, Arabidopsis thaliana; identical to SEQ ID NO: 9566
  misc_feature: Useful for biocontainment applications
  misc_feature: Useful for making plants with altered alkaloid content
  misc_feature: Useful for making plants with altered lignin content
  misc_feature: Useful for making plants with modulated biomass

SEQ ID NO: 51437 - protein, 197 aa, Glycine max; identical to SEQ ID NO: 9588
  misc_feature: Useful for making plants with altered alkaloid content

SEQ ID NO: 51438 - protein, 466 aa, Zea mays
  misc_feature: Useful for making plants with modulated time to senescence
MHSLVRRGNGYGYGYGGYGSSNPHMNYHRQNTESVTTVVTEMNRMAVDDKPCYGGGVQKQACKVEAFQEHDEAYKGAVAVQQKHSSFKEDKEEVRGAAAAVRSWHDELYKEEEEEKHVVDTEYGARYGGGAAAVKKPGYNYKQHEAYGETEGAGYGYGAGGVKKQAGYSYAQEASEESYGGAQSHHGGAGAAAQTYAYDQQQAYKHKDAAGAGYGARYGGGAVQQHDGHGYRPKDAYGYGAAAGGKVKKNGGTDAGGYGAHYGGGGGAVQQYGYGGATTDGKVKKGGYQYYGGSGAGGYDAHYGGGGGGAVQQYGGYHKDAYGYGGGATAGGKVKKSGYQNEEAYAGTGAGGYGAHYGGGPAVAQKQGYRQGIYESESESESESDESDCEEAFLPHGGVQHSYGYGGGAYMQEKHGAGNLGGVRRYESYESRDDLGGGRRYESSYQSTVQYTGSPTKNRHVLRYGA

SEQ ID NO: 51439 - protein, 533 aa, Arabidopsis thaliana
  misc_feature: Useful for making plants with altered cell wall content and/or composition
MELGDTTSVIPDSFMGYRDDITMQMSMVLDQIRAPLIVPALRLGVYICLTMSVMLFVERVYMGIVISLVKLFGRKPDKRFKYEPIKDDIELGNSAYPMVLIQIPMFNEREVYQLSIGAACGLSWPSDRIVIQVLDDSTDPTIKDLVEMECSRWASKGVNIKYEIRDNRNGYKAGALKEGMKKSYVKSCDYVAIFDADFQPEADFLWRTVPYLLHNPKLALVQARWKFVNSDECLMTRMQEMSLDYHFTVEQEVGSSTYAFFGFNGTAGIWRISALNEAGGWKDRTTVEDMDLAVRASLKGWKFLYLGSLKVKNELPSTFKAYRYQQHRWSCGPANLFRKMAFEIMTNKNVTLWKKVHVIYSFFVVRKLVAHIVTFIFYCVILPATVLVPEVTVPKWGAVYIPSVITLLNAVGTPRSLHLMVFWILFENVMSLHRTKATFIGLLEGGRVNEWIVTEKLGDVKAKSATKTSKKVIRFRFGDRIHVLELGVGMYLLFVGCYDAFFGKNHYYLYLFAQAIAFFIAGFGQIGTIVPNH

SEQ ID NO: 51440 - protein, 587 aa, Arabidopsis thaliana
  misc_feature: Useful for making plants with altered cell wall content and/or composition
MAPIKEFISKFSDFKNNKKLILSSAAIALLLLASIVGIAATTTNQNKNQKITTLSSTSHAILKSVCSSTLYPELCFSAVAATGGKELTSQKEVIEASLNLTTKAVKHNYFAVKKLIAKRKGLTPREVTALHDCLETIDETLDELHVAVEDLHQYPKQKSLRKHADDLKTLISSAITNQGTCLDGFSYDDADRKVRKALLKGQVHVEHMCSNALAMIKNMTETDIANFELRDKSSTFTNNNNRKLKEVTGDLDSDGWPKWLSVGDRRLLQGSTIKADATVADDGSGDFTTVAAAVAAAPEKSNKRFVIHIKAGVYRENVEVTKKKTNIMFLGDGRGKTIITGSRNVVDGSTTFHSATVAAVGERFLARDITFQNTAGPSKHQAVALRVGSDFSAFYQCDMFAYQDTLYVHSNRQFFVKCHITGTVDFIFGNAAAVLQDCDINARRPNSGQKNMVTAQGRSDPNQNTGIVIQNCRIGGTSDLLAVKGTFPTYLGRPWKEYSRTVIMQSDISDVIRPEGWHEWSGSFALDTLTYREYLNRGGGAGTANRVKWKGYKVITSDTEAQPFTAGQFIGGGGWLASTGFPFSLSL

SEQ ID NO: 51441 - protein, 272 aa, Arabidopsis thaliana; identical to SEQ ID NO: 9408
  misc_feature: Useful for making plants with altered sterol content

SEQ ID NO: 51442 - protein, 271 aa, Glycine max; identical to SEQ ID NO: 9661
  misc_feature: Useful for making plants with modulated cold sensitivity

SEQ ID NO: 51443 - protein, 329 aa, Arabidopsis thaliana
  misc_feature: Useful for making plants with altered cell wall content and/or composition
MKTMTQLNIAVVVVVTVLIGMLRSSEAQLQMNFYAKSCPNAEKIISDHIQNHIHNGPSLAAPLIRMHFHDCFVRGCDGSVLINSTSGNAERDAPPNLTLRGFGFVERIKALLEKVCPKTVSCADIIALTARDAVVATGGPSWSVPTGRRDGRISNKTEATNNIPPPTSNFTTLQRLFKNQGLNLKDLVLLSGAHTIGVSHCSSMNTRLYNFSTTVKQDPSLDSQYAANLKANKCKSLNDNSTILEMDPGSSRSFDLSYYRLVLKRRGLFQSDSALTTNSATLKVINDLVNGSEKKFFKAFAKSMEKMGRVKVKTGSAGVIRTRCSVAGS

SEQ ID NO: 51444 - protein, 242 aa, Arabidopsis thaliana; identical to SEQ ID NO: 9452
  misc_feature: Useful for making plants with altered terpenoid content
  misc_feature (121)..(121): Xaa is any aa, unknown, or other

SEQ ID NO: 51445 - protein, 158 aa, Arabidopsis thaliana; identical to SEQ ID NO: 9700
  misc_feature: Useful for making plants with modulated nitrogen use efficiency

SEQ ID NO: 51446 - protein, 181 aa, Arabidopsis thaliana
  misc_feature: Useful for making plants with altered cell wall content and/or composition
MLKGSYDFIGVNYYSSLYAKDVPCATENITMTTDSCVSLVGERNGVPIGPAAGSDWLLIYPKGIRDLLLHAKFRYNDPVLYITENGVDEANIGKIFLNDDLRIDYYAHHLKMVSDAISIGVNVKGYFAWSLMDNFEWSEGYTVRFGLVFVDFEDGRKRYLKKSAKWFRRLLKGAHGGTNEQ

SEQ ID NO: 51447 - protein, 220 aa, Arabidopsis thaliana
  misc_feature: Useful for making plants with modulated cold sensitivity
MATVKGLLKGLRYITQIFDEEKDKDMQIGFPTDVKHVAHIGSDGPATNVPSWMGDFKPQENENGQVVSRADANNNQIGEGVGLQELLPPTDKPKHKKTRRKSETVSQNGSPPRRNSSASASDMQPKNTRRHHRSRHGSIDSSNDPSVRRRRVVSVTTNDMEGSYPLSDSSTHSRKSTSRHRKPKGSGGGELSMKKTKGKTENPIVESVDTCNDNNISDKE

SEQ ID NO: 51448 - protein, 111 aa, Arabidopsis thaliana
  misc_feature: Useful for making plants with altered cell wall content and/or composition
MDRNGANMLDGRVESDAKGSFRKDYTKMENNNNGANISDGIYRIIRSFKSFSHFFIRYEEETKEREAEMEIGFPTDVKHLSHIGVDGTMTTFDNTSSSFPFSGFHLTGTVV

SEQ ID NO: 51449 - protein, 679 aa, Arabidopsis thaliana
  misc_feature: Useful for making plants with modulated flowering time
MYAGGDMHRGSQMPQPPMMRQSSASSTNINPDYHHPSGPFDPNVDSFGAKRMRKHTQRRAVDYTSTVVRYIQARTWQRDSRDRTTLQPTPAAAVDMLPTVAYSDNPSTSFAAKFVHASLNKNRCSINRVLWTPSGRRLITGSQSGEFTLWNGQSFNFEMILQAHDQPIRSMVWSHNENYMVSGDDGGTLKYWQNNMNNVKANKTAHKESIRDLRIGFLGYIGKGVIEIRFGVMPCNAGHGWDVKSVDWHPTKSLLVSGGKDQLVKLWDTRSGRELCSLHGHKNIVLSVKWNQNGNWLLTASKDQIIKHLYDTYACNLQLYDIRTMKELQSFRGHTKDLWRGIPAMKNILSVGALTAPFVIGLWGRHENPQIEIPNAHDNSVWDLAWHPIGYLLCRPADNPRDVLMQNQGLTGQALAGSVIYSYNGWFEMDLGFLRFRLGQPYGTALKTQTQVLGYNEQGFGRQPDNFQPSEASPIPGAFVPGLTRNEGTIPGIGIAMPFDASSQGDHKQPLPGSMALGAPPLPPGPHPSLLGSGQQQGYQQQQQHQGHPQQMLPMPNMPHHQLPPSSHMPLHPHHLPRPMQMPPHGHMPPPSMPMSHQMPGSMGMQGGMNPQMSQSHFMGAPSGVFQGQPNSGGPQMYPQGRGGFNRPQMIPGYNNPFQQQQQPPLPPGPPPNNNQQHQ

SEQ ID NO: 51450 - protein, 507 aa, Arabidopsis thaliana
  misc_feature: Useful for making plants with altered cell wall content and/or composition
MRTKYFSLLVFIIVLASNEVIAKKHSSTPKLRRSDFPKDFIFGAATSAYQVEGAAHEDGRGPSIWDTFSEKYPEKIKDGTNGSIASDSYHLYKEDVGLLHQIGFGAYRFSISWSRILPRGNLKGGINQAGIDYYNNLINELLSKGIKPFATIFHWDTPQSLEDAYGGFFGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYTESAEDRLAAARAMAFTFDYFMEPLVTGKYPVDMVNNVKDGRLPTFTAKQSKMLKGSYDFIGINYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYSVRFGLVYVDFNDGRKRYPKKSAKWFRKLLSEKKRN

SEQ ID NO: 51451 - protein, 515 aa, Arabidopsis thaliana
  misc_feature: Useful for making plants with altered cell wall content and/or composition
MVAKPRSRCCCCSVFIGVIILIAIIIAVIFTIRHRSNHSDDDGSNVKNYANALKIAMQFFDIQKSGKLENNEISWRGDSGLKDGSEASIDLSKGLYDAGDHMKFGFPMAFTATVLSWSILEYGDQMASLNLLDHAKDSLKWTTDFLINAHPSPNVLYIQVGDPVTDHKCWDRPETMTRKRTLTKIDTKTPGTEVAAETAAAMAAASLVFKESDTKYSSTLLKHAKQLFDFADNNRGSYSVNIPEVQSYYNSTGYGDELLWAASWLYHATEDQTYLDFVSENGEEFGNFGSPSWFSWDNKLPGTHILLSRLTFFKKGLSGSKGLQGFKETAEAVMCGLIPSSPTATSSRTDGGLIWVSEWNALQHPVSSAFLATLYSDYMLTSGVKELSCSDQSFKPSDLRKFARSQADYMLGKNPEKMSYLVGYGEKYPEFVHHRGASIPADATTGCKDGFKWLNSDEPNPNVAYGALVGGPFLNDTFIDARNNSMQNEPSTYNSALVVGLLSSLVTTSSSVESF

SEQ ID NO: 51452 - protein, 373 aa, Panicum virgatum; identical to SEQ ID NO: 5124
  misc_feature: Useful for making plants with altered carbohydrate content

SEQ ID NO: 51453 - protein, 361 aa, Arabidopsis thaliana
  misc_feature: Useful for making plants with altered cell wall content and/or composition
MASRSLNGDSDIVKPRKIALVTGITGQDGSYLTEFLLEKGYEVHGLIRRSSNFNTQRLNHIYVDPHNVNKALMKLHYGDLSDASSLRRWLDVIKPDEVYNLAAQSHVAVSFEIPDYTADVVATGALRLLEAVRSHNIDNGRAIKYYQAGSSEMFGSTPPPQSETTPFHPRSPYAASKCAAHWYTVNYREAYGLYACNGILFNHESPRRGENFVTRKITRALGRIKVGLQTKLFLGNIQASRDWGFAGDYVEAMWLMLQQEKPDDYVVATEESHTVKEFLDVSFGYVGLNWKDHVEIDKRYFRPTEVDNLKGDASKAKEMLGWKPKVGFEKLVKMMVDEDLELAKREKVLADAGYMDAQQQP

SEQ ID NO: 51454 - protein, 217 aa, Zea mays
  misc_feature: Useful for making plants with modulated salt sensitivity
MGKKGKWFGAVKKVFSPESKEKKEESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 51455 - protein, 303 aa, Arabidopsis thaliana; identical to SEQ ID NO: 9205
  misc_feature: Useful for making plants with modulated salt sensitivity

SEQ ID NO: 51456 - protein, 159 aa, Arabidopsis thaliana; identical to SEQ ID NO: 9560
  misc_feature: Useful for making plants with altered lignin content

SEQ ID NO: 51457 - protein, 123 aa, Arabidopsis thaliana
  misc_feature: Useful for making plants with altered lignin content
MVYDVTRRDTFTNLSDIWAKEIDLYSTNQDCIKMLVGNKVDKESERAVSKKEGIDFAREYGCLFLECSAKTRVNVEQCFEELVLKILETPSLTAEGSSGGKKNIFKQNPAQTTSTSSSYCCSS

SEQ ID NO: 51458 - protein, 177 aa, Arabidopsis thaliana
  misc_feature: Useful for making plants with modulated flowering time
MENMGTRVIEPLIMGRVVGDVLDFFTPTTKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFRQKQRRVIFPNIPSRDHFNTRKFAVEYDLGLPVAAVFFNAQRETAARKR

SEQ ID NO: 51459 - protein, 247 aa, Arabidopsis thaliana
  misc_feature: Useful for making plants with altered cell wall content and/or composition
MESNSIIWSLLLASALISSFSVNAQGPAASPVTSTTTAPPPTTAAPPTTAAPPPTTTTPPVSAAQPPASPVTPPPAVTPTSPPAPKVAPVISPATPPPQPPQSPPASAPTVSPPPVSPPPAPTSPPPTPASPPPAPASPPPAPASPPPAPVSPPPVQAPSPISLPPAPAPAPTKHKRKHKHKRHHHAPAPAPIPPSPPSPPVLTDPQDTAPAPSPNTGGNALNQLKGRAVMWLNTGLVILFLLAMTA

SEQ ID NO: 51460 - protein, 117 aa, Arabidopsis thaliana; identical to SEQ ID NO: 9414
  misc_feature: Useful for making plants with modulated biomass

SEQ ID NO: 51461 - protein, 1808 aa, Arabidopsis thaliana
  misc_feature: Useful for making plants with altered cell wall content and/or composition
MEASSSGTAELPRSLSRRAPSRATTMMIDRPNEDASAMDSELVPSSLASIAPILRVANEIEKDNPRVAYLCRFHAFEKAHRMDATSSGRGVRQFKTYLLHRLEKEEEETKPQLAKNDPREIQAYYQNFYEKYIKEGETSRKPEEMARLYQIASVLYDVLKTVVPSPKVDYETRRYAEEVERKRDRYEHYNILPLYAVGTKPAIVELPEVKAAFSAVRNVRNLPRRRIHLPSNTPNEMRKARTKLNDILEWLASEFGFQRGNVANQREHIILLLANADIRKRNDEEYDELKPSTVTELMDKTFKSYYSWCKYLHSTSNLKSDVGCFNFILKRFPDDCDKQQLQLIYISLYLLIWGEASNMANDVYGILFSNVEAVSGETYETEEVIDEESFLRTVITPIYQVIRNEAKRNKGGTASHSQWRNYDDLNEYFWSKKCFKIGWPLDLKADFFLNSDEITPQDERLNQVTYGKSKPKTNFVEVRTFWNLFRDFDRMWIFLVMAFQAMVIVGWHGSGSLGDIFDKDVFKTVLTIFITSAYLTLLQVAFMWAVLLPIAYSKSVQRPTGVVKFFSTWTGDWKDQSFYTYAVSFYVLPNILAALLFLVPPFRRAMECSDMRPIKVIMWWAQATTNNIGVVIAIWAPIVLVYLMDTQIWYAIFSTLFGGIHGAFSHLGEIRTLGMLRSRFESIPIAFSRTLMPSEDAKRKHADDYVDQKNITNFSQVWNEFIYSMRSEDKISDRDRDLLLVPSSSGDVSVIQWPPFLLASKIPIAVDMAKDFKGKEDAELFRKIKSDSYMYYAVIESYETLKKIIYALLEDEADRRVMNQVFLEVDMSMQQQRFIYEFRMSGLPLLSDKLENDYEDQGTYKSQLINVFQDVIEIITQDLLVNGHEILERARVHSPDIKNEKKEQRFEKINIHLVRDRCWREKVIRLHLLLSVKESAINVPQNLEARRRITFFANSLFMNMPSAPRIRDMLSFSVLTPYYKEDVLYSEEDLNKENEDGISILFYLQKIYPDEWTNYLDRLKDPKLPEKDKSEFLREWVSYRGQTLARTVRGMMYYRQALELQCYQEVAGEQAEFSVFRAMASNDENQKAFLERARALADLKFTYVVSCQVYGNQKKSGDIHNRSCYTNILQLMLKEETADAKSPKVFYSVLLKGGDKFDEEIYRIKLPGPPAEIGEGKPENQNHAIIFTRGEALQTIDMNQDNYFEEAFKLRNVLEEFNKERVGRRKPTILGLREHIFTGSVSSLAWFMSNQESSFVTIGQRILANPLRVRFHYGHPDIFDRIFHITRGGVSKASKVINLSEDIFGGFNSTLRGGYVTHHEYIQVGKGRDVGLNPISIFEAKVANGNGEQTLSRDVYRLGHRFDFYRMLSFYFTTIGFYFSSMLTVLTVYAFLYGRMYMVMSGLEKEILRLASPNQLEALEQALATQSIFQLGFLMVLPMVMEIGLEHGFRSAIVDFFIMQLQLASVFFTFQLGTKSHYYGRTILHGGSKYRPTGRGFVVFHAKFAENYRLYSRSHFVKGLELLLLLVVYQIYGHSYRSSNLYLYITVSMWFMVGSWLFAPFIFNPSGFEWQKTVDDWTDWKRWLGDRGGIGIPVEKSWESWWNVEQEHLKHTSIRGRILEITLALRFFIYQYGIVYQLNISQRSKSFLVYGLSWVVLLTSLLVLKMVSMGRRRFGTDFQLMFRILKALLFLGFLSVMTILFVVFKLTLTDLSASVLAFLPTGWAILLIGQVLRSPIKALGVWDSVKELGRAYENIMGLVIFAPIAVLSWFPIVSEFQARLLFNQAFSRGLQISMILAGRKDKATSSHK

SEQ ID NO: 51462 - protein, 178 aa, Arabidopsis thaliana
  misc_feature: Useful for making plants with altered terpenoid content
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKAMSQAEKAPYEEKAAKRKAEYEKQMDAYNKNLEEGSDESEKSRSEINDEDEASGEEELLEKEAAGDDEEEEEEEDDDNDDDEEED

SEQ ID NO: 51463 - protein, 390 aa, Zea mays
  misc_feature: Useful for making plants with modulated flowering time
MAEQWWGSASHRSHGTSACSAAAPPPLTVTGRVACGSTFPTAAVESTSSVTFQDPYRSSTHQPLSDAASSLGDPHLDWTQTFLSGRSDASFQAVLQEPSATNDPLIRDHMDMGAGFLADQAQLAPSPYGDTEPSQAQALFDATAAVHNILMYGDSESSVSYDAGAASMQFSQLLRTSVPASTPTPTQGDGVSVGVGAPMQYLSGSSYLPFGGPLPSHLLLQALQAAKPNSRSSNANSPSAKDDCSPPPAATRKSVSEPPAAAKRPRIEAPSPLPTFKVRKEKLGDRITALQQLVSPFGKTDTASVLHEAIEYIKFLHDQVASLSSPYLKNGIPMKQFQHKGSEDSKDNGDTKQADLRSRGLCLVPVASTYTVAAETPEFWHPTFGGTFRW

SEQ ID NO: 51464 - protein, 723 aa, Arabidopsis thaliana
  misc_feature: Useful for making plants with modulated low light sensitivity
  misc_feature: Useful for making plants with modulated nitrogen use efficiency
MSNTVEDDDDDFQIPPSSQLSIRKPLHPTNANNISHRPPNKKPRLCRYPGKENVTPPPSPDPDLFCSSSTPHCILDCIPSSVDCSLGDFNGPISSLGEEDKEDKDDCIKVNREGYLCNSMEARLLKSRICLGFDSGIHEDDEGFVESNSELDVLINLCSESEGRSGEFSLGKDDSIQCPLCSMDISSLSEEQRQVHSNTCLDKSYNQPSEQDSLRKCENLSSLIKESIDDPVQLPQLVTDLSPVLKWLRSLGLAKYEDVFIREEIDWDTLQSLTEEDLLSIGITSLGPRKKIVNALSGVRDPFASSAEVQAQSHCTSGHVTERQRDKSTTRKASEPKKPTANKLITEFFPGQATEGTKIRTAPKPVAEKSPSDSSSRRAVRRNGNNGKSKVIPHWNCIPGTPFRVDAFKYLTRDCCHWFLTHFHLDHYQGLTKSFSHGKIYCSLVTAKLVNMKIGIPWERLQVLDLGQKVNISGIDVTCFDANHCPGSIMILFEPANGKAVLHTGDFRYSEEMSNWLIGSHISSLILDTTYCNPQYDFPKQEAVIQFVVEAIQAEAFNPKTLFLIGSYTIGKERLFLEVARVLREKIYINPAKLKLLECLGFSKDDIQWFTVKEEESHIHVVPLWTLASFKRLKHVANRYTNRYSLIVAFSPTGWTSGKTKKKSPGRRLQQGTIIRYEVPYSEHSSFTELKEFVQKVSPEVIIPSVNNDGPDSAAAMVSLLVT

SEQ ID NO: 51465 - protein, 365 aa, Arabidopsis thaliana; identical to SEQ ID NO: 9659
  misc_feature: Useful for biocontainment applications

SEQ ID NO: 51466 - protein, 183 aa, Brassica napus
  misc_feature: Useful for making plants with altered lignin content
  misc_feature (146)..(146): Xaa is any aa, unknown, or other
MGAFASRFWFMMFPAKEYKIVVVGLDNAGKTTTLYKLHLGEVVTTHPTVGSNVEELVYKNIRFEVWDLGGQDRLRTSWATYYRGTNAVIVVIDSTDRARISLMKDELSRLLGHEDLHNSVILVFANKQDLKDAMSPAEITDALNLXSIKNHDWHIQASCAVTGEGLHDGLGWIAQKVTEKPPS

SEQ ID NO: 51467 - protein, 802 aa, Panicum virgatum; identical to SEQ ID NO: 672
  misc_feature: Useful for making plants with altered carbohydrate content

SEQ ID NO: 51468 - protein, 809 aa, Arabidopsis thaliana
  misc_feature: Useful for making plants with altered cell wall content and/or composition
MANPKLTRVLSTRDRVQDTLSAHRNELVALLSRYVDQGKGILQPHNLIDELESVIGDDETKKSLSDGPFGEILKSAMEAIVVPPFVALAVRPRPGVWEYVRVNVFELSVEQLTVSEYLRFKEELVDGPNSDPFCLELDFEPFNANVPRPSRSSSIGNGVQFLNRHLSSVMFRNKDCLEPLLDFLRVHKYKGHPLMLNDRIQSISRLQIQLSKAEDHISKLSQETPFSEFEYALQGMGFEKGWGDTAGRVLEMMHLLSDILQAPDPSSLEKFLGMVPMVFNVVILSPHGYFGQANVLGLPDTGGQVVYILDQVRALETEMLLRIKRQGLDISPSILIVTRLIPDAKGTTCNQRLERVSGTEHTHILRVPFRSEKGILRKWISRFDVWPYLENYAQDAASEIVGELQGVPDFIIGNYSDGNLVASLMAHRMGVTQCTIAHALEKTKYPDSDIYWKDFDNKYHFSCQFTADLIAMNNADFIITSTYQEIAGTKNTVGQYESHGAFTLPGLYRVVHGIDVFDPKFNIVSPGADMTIYFPYSEETRRLTALHGSIEEMLYSPDQTDEHVGTLSDRSKPILFSMARLDKVKNISGLVEMYSKNTKLRELVNLVVIAGNIDVNKSKDREEIVEIEKMHNLMKNYKLDGQFRWITAQTNRARNGELYRYIADTRGAFAQPAFYEAFGLTVVEAMTCGLPTFATCHGGPAEIIEHGLSGFHIDPYHPEQAGNIMADFFERCKEDPNHWKKVSDAGLQRIYERYTWKIYSERLMTLAGVYGFWKYVSKLERRETRRYLEMFYILKFRDLVKTVPSTADD

SEQ ID NO: 51469 - protein, 158 aa, Arabidopsis thaliana
  misc_feature: Useful for making plants with altered alkaloid content
MQVEIALQRDRHNMGRRYVEVFRCSKQDYYNAVAAEEGAYEYEVRASPPPTGPSRAKRFSEKEKLEYTEVLKMRGLPYSVNKPQIIEFFSGYKVIQGRVQVVCRPDGKATGEAFVEFETGEEARRAMAKDKMSIGSRYVELFPTTREEARRAEARSRQ

SEQ ID NO: 51470 - protein, 782 aa, Panicum virgatum; identical to SEQ ID NO: 3330
  misc_feature: Useful for making plants with altered carbohydrate content

SEQ ID NO: 51471 - protein, 435 aa, Arabidopsis thaliana
  misc_feature: Useful for making plants with altered cell wall content and/or composition
MKQLHKQMSSKRDEETIPMSQSSPYSPKTLKHPRSLPRSLHYLFREQRLLFILVGILIGSTFFILQPSLSRLGAAESTSLITRSVSYAVTDSPPSRSTFNSGGGGGRTGRVPVGIGRKRLRIVVTGGAGFVGSHLVDKLIGRGDEVIVIDNFFTGRKENLVHLFSNPRFELIRHDVVEPILLEVDQIYHLACPASPVHYKYNPVKTIITNVMGTLNMLGLAKRVGARFLLTSTSEVYGDPLEHPQKETYWGNVNPIGERSCYDEGKRTAETLAMDYHRGAGVEVRIARIFNTYGPRMCLDDGRVVSNFVAQTIRKHPMTVYGDGKQTRSFQYVSDLVEGLVALMENDHVGPFNLGNPGEFTMLELAEVVKEVIDPSATIEFKPNTADDPHKRKPDISKAKEQLNWEPKISLREGLPRMVSDFRNRILNEDEGKGL

SEQ ID NO: 51472 - protein, 475 aa, Arabidopsis thaliana
  misc_feature: Useful for making plants with altered cell wall content and/or composition
MRRLSGILVIYIISTVLFGHFTNVARARYHYHKGRHGVTHPLPPPPPPPLETANPPDQVPSDPYPSPDPAPGDSDSGCVFDVTSFGAVGDGSCDDTAAFQDAWKAACAVESGVVLAPEGGVFKITSTIFSGPCKPGLVFQLDGVLMPPDGPEEWPEKDNKNQWLVFYRLDGFTFSGKGTVEGNGQKWWDLPCKPHRGPDGSSSSGPCASPTMIRFFMSNNIEVKGLRIQNSPQFHMKFDGCQGVLINEIQISSPKLSPNTDGIHLGNTRSVGIYNSVVSNGDDCISIGTGCSDVDIQGVTCGPSHGISIGSLGVHNSQACVSNITVRNTVIRDSDNGLRVKTWQGGTGSVSNLLFENIQMENVLNCIIVDQYYCQSKDCRNETSAVKVFDVEYRNIKGTYDVRSPPIHFACSDTVACTNITMSEVELLPEEGELVDDPFCWNAYGKQETLTIPPIDCLLDGSPVVEEAYDSNYGC

SEQ ID NO: 51473 - protein, 400 aa, Panicum virgatum; identical to SEQ ID NO: 2868
  misc_feature: Useful for making plants with altered carbohydrate content

SEQ ID NO: 51474 - protein, 246 aa, Panicum virgatum; identical to SEQ ID NO: 280
  misc_feature: Useful for making plants with altered carbohydrate content

SEQ ID NO: 51475 - protein, 195 aa, Arabidopsis thaliana
  misc_feature: Useful for making plants with altered cell wall content and/or composition
MVCACMRRSEMEVPVDEGHFLSMLLKIMNAKKTIELGVFTGYSLLTTALALPHDGHVTGIDIDKEAYEMGLEFIKNAGVHHKINFIHSDCLQALDNMLSENPKPEFDFAFVDADKPNYANMHERLMKLVKVGGVIAFDNTLWSGFVAEKEENVPVHMRVNRKAFLDLNKRLAADPHVEVSQVSIGDGVTLCRRLV

SEQ ID NO: 51476 - protein, 233 aa, Arabidopsis thaliana
  misc_feature: Useful for making plants with altered lignin content
  misc_feature (170)..(170): Xaa is any aa, unknown, or other
MDGRLPDKGILKSEALKQYIMETTAYPREHELLKELREATIQRYGNLSEMGVPVDESLFLSMLVKIINAKNTIEIGVFTGYSLFTVALALPEDGRITAIDIDQAGYNLGLEFMKKAGVDHKINFIQSDAVRGLDQLLNGEKQEYDFAFVDADKTNYVYFLEKLLKLVKVXGIIAFDNTLWFGTLIQKENEVPGHMRAYREALLEFNKILARDPRVEIAQISIGDGLTLCRRLI

SEQ ID NO: 51477 - protein, 458 aa, Zea mays
  misc_feature: Useful for making plants with modulated biomass
  misc_feature: Useful for making plants with modulated flowering time
GYNVSSDELYHVVEASGLHNSLGGYLNDTRTLLELHKASTVSISEDESILDSIGSRSRTLLREQLESGGALRKPSLFKEVEHALDGPFYTTLDRLHHRWNIENFNIIEQHMLETPYLSNQHTSRDILALSIRDFSSSQFTYQQELQHLESWVKECRLDQLQFARQKLAYFYLSAAGTMFSPELSDARTLWAKNGVLTTIVDDFFDVAGSKEELENLVMLVEMWDEHHKVEFYSEQVEIIFSSIYDSVNQLGEKASLVQDRSITKHLVEIWLDLLKSMMTEVEWRLSKYVPTEKEYMINASLTFGLGPIVLPALYFVGPKISESIVKDPEYDELFKLMSTCGRLLNDVQTFEREYNEGKLNSVSLLVLHGGSMSISDAKRKLQKPIDTCRRDLLSLVLREESVVPRPCKELFWKMCKVCYFFYSTTDGFSSQVERAKEVDAVINEPLKLQGSHTLVSDV

SEQ ID NO: 51478 - protein, 255 aa, Arabidopsis thaliana [sequence omitted]

SEQ ID NO: 51479 - protein, 134 aa, Arabidopsis thaliana; identical to SEQ ID NO: 9638
  misc_feature: Useful for biocontainment applications

SEQ ID NO: 51480 - protein, 235 aa, Zea mays; identical to SEQ ID NO: 9403
  misc_feature: Useful for making plants with altered alkaloid content

SEQ ID NO: 51481 - protein, 221 aa, Glycine max
  misc_feature: Useful for making plants with altered lignin content
MGRGKIVIRRIDNSTSRQVTFSKRRNGLVKKARELSILCDAEVGLIVFSSTGKLYDYASTSMKSVIERYNKVKEDHQQLINPASEVKLWQREVASLRQQVQYMQECHRQMMGQELSGLGIEELGNLEKRLEMSLKGVRMKKDQILIDEVKELHQKGSLAHQENVELNRKINLIRKENEELQKVIEAKCRKGVAASNPPFTINYGCNMLAPISLQLSLPEST

SEQ ID NO: 51482 - protein, 256 aa, Arabidopsis thaliana
  misc_feature: Useful for making plants with modulated biomass
  misc_feature: Useful for making plants with modulated flowering time
MGRGRIEIKKIENINSRQVTFSKRRNGLIKKAKELSILCDAEVALIIFSSTGKIYDFSSVCMEQILSRYGYTTASTEHKQQREHQLLICASHGNEAVLRNDDSMKVELERLQLAIERLKGKELEGMSFPDLISFENQLNESLHSVKDQKTQILLNQIERSRIQEKKALEENQILRKQVEMLGRGSGPKVLNERPQDSSPEADPESSSSEEDENDNEEHHSDTSLQLGLSSTGYCTKRKKPKIELVCDNSGSQVASD

SEQ ID NO: 51483 - protein, 172 aa, Arabidopsis thaliana
  misc_feature: Useful for making plants with altered alkaloid content
  misc_feature: Useful for making plants with altered terpenoid content
  misc_feature: Useful for making plants with altered tocopherol content
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 51484 - protein, 267 aa, Zea mays
  misc_feature: Useful for making plants with altered alkaloid content
  misc_feature: Useful for making plants with altered terpenoid content
MFPSLIHHASHGRPDVAVAEDAPRSGCGLGLPGHGGGPSVVLTADPKPRLRWTADLHDRFVDAVAQLGGPDKATPKAIMRTMGVKGLTLFHLKSHLQKYRLGRQSGKELTEQSKDASYLMEAQSGTTLSPRGSTPDVKESQEVKEALRAQMEVQRRLHEQVEVQKHMQIRMEANQKYIDTILDKAFKIVSEQLSGFSISDQDLPILTSARAMLSPADHLSSSVFPQLSVSSVSLHNPGPGGGKGLPHVADSHVFSQRPPEQFKRKSR

SEQ ID NO: 51485 - protein, 558 aa, Arabidopsis thaliana
  misc_feature: Useful for making plants with altered cell wall content and/or composition
MDQNSYRRRSSPIRTTTGGSKSVNFSELLQMKYLSSGTMKLTRTFTTCLIVFSVLVAFSMIFHQHPSDSNRIMGFAEARVLDAGVFPNVTNINSDKLLGGLLASGFDEDSCLSRYQSVHYRKPSPYKPSSYLISKLRNYEKLHKRCGPGTESYKKALKQLDQEHIDGDGECKYVVWISFSGLGNRILSLASVFLYALLTDRVLLVDRGKDMDDLFCEPFLGMSWLLPLDFPMTDQFDGLNQESSRCYGYMVKNQVIDTEGTLSHLYLHLVHDYGDHDKMFFCEGDQTFIGKVPWLIVKTDNYFVPSLWLIPGFDDELNKLFPQKATVFHHLGRYLFHPTNQVWGLVTRYYEAYLSHADEKIGIQVRVFDEDPGPFQHVMDQISSCTQKEKLLPEVDTLVERSRHVNTPKHKAVLVTSLNAGYAENLKSMYWEYPTSTGEIIGVHQPSQEGYQQTEKKMHNGKALAEMYLLSLTDNLVTSAWSTFGYVAQGLGGLKPWILYRPENRTTPDPSCGRAMSMEPCFHSPPFYDCKAKTGIDTGTLVPHVRHCEDISWGLKLV

SEQ ID NO: 51486 - protein, 229 aa, Arabidopsis thaliana
  misc_feature: Useful for making plants with altered terpenoid content
MPSFAFGSHHHLANPTDSPPYSVEISIDGDSSDLDSLSQVDLESGGVPAPEKQLHSGGKKRRTRRRKRRKKKKKKKGGRDCRICHLPLETNKEAEDEDEEEEDDSDDDEDEEDEEEEEEEEEYYGLPLQLGCSCKGDLGVAHSKCAETWFKIKGNMTCEICGAMALNVAGEQSNPESTASTHSQAAAGQSLTQTEPRGIWHGRPVMNFLLAAMVFAFVVSWLFHFKVLK

SEQ ID NO: 51487 - protein, 377 aa, Arabidopsis thaliana; identical to SEQ ID NO: 9536
  misc_feature: Useful for making plants with modulated biomass

SEQ ID NO: 51488 - protein, 349 aa, Arabidopsis thaliana
  misc_feature: Useful for making plants with altered cell wall content and/or composition
MGFSPSFSCSAIGALILGCLLLQASNSNAQLRPDFYFGTCPFVFDIIGNIIVDELQTDPRIAASLLRLHFHDCFVRGCDASILLDNSTSFRTEKDAAPNANSARGFNVIDRMKVALERACPGRVSCADILTIASQISVLLSGGPWWPVPLGRRDSVEAFFALANTALPSPFFNLTQLKTAFADVGLNRTSDLVALSGGHTFGRAQCQFVTPRLYNFNGTNSPDPSLNPTYLVELRRLCPQNGNGTVLVNFDVVTPDAFDSQYYTNLRNGKGLIQSDQELFSTPGADTIPLVNQYSSDMSVFFRAFIDAMIRMGNLRPLTGTQGEIRQNCRVVNPRIRVVENDDGVVSSI

SEQ ID NO: 51489 - protein, 320 aa, Arabidopsis thaliana
  misc_feature: Useful for making plants with altered cell wall content and/or composition
MTLFVYGYSAAAEQIAYTITVDLNGGGNFTTVQSAIDSISPPNHNWIRVFTQNGIYREKVTIPKEKGFIYLQGKGIEQTVIEYDDHQATDISATFTAFADDIVISGITFKNTYNIVPNNKREIVPAVAARMLGDRYVVTDSSFVGLQDTLFDGKGRHYYKRCIISGGIDFIFGYGQSLFKECTLNMTLGIYAPDNPYGTITAHQRPSPSDEGGFVFSDCTVTGVGKTLLGRAWGSNARVIFDRSRLSDVVLPIGWDAWRAKGNERDLTFVEAGCTGAGADTSQRVPWLKKLSLSEVDGFASVSFIDQDGWISRFPIEGGP

SEQ ID NO: 51490 - protein, 331 aa, Panicum virgatum; identical to SEQ ID NO: 4908
  misc_feature: Useful for making plants with altered carbohydrate content

SEQ ID NO: 51491 - protein, 329 aa, Arabidopsis thaliana
  misc_feature: Useful for making plants with altered cell wall content and/or composition
MVVVNKTNLLLLLLSLCLTLDLSSAQLRRNFYAGSCPNVEQIVRNAVQKKVQQTFTTIPATLRLYFHDCFVNGCDASVMIASTNNNKAEKDHEENLSLAGDGFDTVIKAKEALDAVPNCRNKVSCADILTMATRDVVNLAGGPQYDVELGRLDGLSSTAASVGGKLPHPTDDVNKLTSLFAKNGLSLNDMIALSGAHTLGFAHCTKVFNRIYTFNKTTKVDPTVNKDYVTELKASCPRNIDPRVAINMDPTTPRQFDNVYYKNLQQGKGLFTSDQVLFTDRRSKPTVDLWANNGQLFNQAFINSMIKLGRVGVKTGSNGNIRRDCGAFN

SEQ ID NO: 51492 - protein, 285 aa, Arabidopsis thaliana; identical to SEQ ID NO: 9543
  misc_feature: Useful for biocontainment applications

SEQ ID NO: 51493 - protein, 2678 aa, Arabidopsis thaliana
  misc_feature: Useful for making plants with modulated flowering time
MGNVEIPNWLKALPLAPVFRPTDTEFADPIAYISKIEKEASAFGICKIIPPLPKPSKKYVFYNLNKSLLKCPELVSDVDISKVCKEDRAVFTTRQQELGQTVKKNKGEKGKSNSQRSGVKQVWQSGGVYTLDQFEAKSKAFYKTQLGTVKELAPVVIEALFWKAALEKPIYIEYANDVPGSAFGEPEDHFRHFRQRKRRGRGFYQRKTENNDPSGKNGEKSSPEVEKAPLASTSLSSQDSSKQKNMDIVDEMEGTAGWKLSNSSWNLQMIARSPGSVTRFMPDDIPGVTSPMVYIGMLFSWFAWHVEDHELHSMNYLHTGSPKTWYAVPCDYALDFEEVIRKNSYGRNIDQLAALTQLGEKTTLVSPEMIVASGIPCCRLVQNPGEFVVTFPRSYHVGFSHVAQRSKGSCCASGSHELSTHAVPSAAAISLDYVLCFKAVPRSLLPGGRSSRLRDRQREEREFLVKRAFVEDILNENKNLSVLLREPGSRLVMWDPDLLPRHSALALAAAGVAGASAVSPPAVAKKELEEGHSELQNKEKTSLLEELSLFMEKLNDVYYDDDDGLLNDFQVDTGTLPCVACGVLGFPFMSVVQPSEKALKDLSERQGETDAQEIMTLSSEKSDCEWKTSSRYIRPRIFCLEHTIELQRLLQSRGGLKFLVICHKDFQKFKAHAAIVAEEVKVPFSYDDVLLESASQEELSLIDLAIEDEEKYEHSVDWTSELGINLRYCVKVRKNSPTKKIQHALSLGGLFSDTSQMLDFTTIRWLQRKSRSKAKPSSTSSFTPCEHLEVKADGKLRDNLDSQTGKKEEKIIQYSRKKKLNPKPSAEQVQELATLAKSKDFDKTCKNFSSRSHLDSAIRSEMNSEIGDSGRVIGVSFSINPCSSSFTVGHGQEHPEITVKFGSDLDGNVTNSLSMVNGDSADLTLTSISREQHQGHSMTSNNNGSNSGSHVVASQTILVSTGDNHDGPRKLSGDYVCSDVSVRGIQEAVEMSDQEFGEPRSTVTNIEDEQQSQIVKPTQREAVFGDHEQVEGAEAVSTRENLCSEIILHTEHSSAHVGMEIPDINTASENLVVDMTHDGEPLESSDILSSSNGDEASSNGLQVLNDELSMESEVSSSENTEVIEAPNSMGEAKKKRKIESESETNDNPESSIGFIRSPCEGLRSRGKRKATCETSLKHTETSDEEKKPIAKRLKKTPKACSGSRQQEVPTTTHPNRCYLEGCKMTFESKAKLQTHKRNRCTHEGCGKKFRAHKYLVLHQRVHKDERPFECSWKGCSMTFKWQWARTEHLRLHTGERPYICKVDGCGLSFRFVSDYSRHRRKTMHYVTMGNVEIPNWLKALPLAPVFRPTDTEFADPIAYISKIEKEASAFGICKIIPPLPKPSKKYVFYNLNKSLLKCPELVSDVDISKVCKEDRAVFTTRQQELGQTVKKNKGEKGKSNSQRSGVKQVWQSGGVYTLDQFEAKSKAFYKTQLGTVKELAPVVIEALFWKAALEKPIYIEYANDVPGSAFGEPEDHFRHFRQRKRRGRGFYQRKTENNDPSGKNGEKSSPEVEKAPLASTSLSSQDSSKQKNMDIVDEMEGTAGWKLSNSSWNLQMIARSPGSVTRFMPDDIPGVTSPMVYIGMLFSWFAWHVEDHELHSMNYLHTGSPKTWYAVPCDYALDFEEVIRKNSYGRNIDQLAALTQLGEKTTLVSPEMIVASGIPCCRLVQNPGEFVVTFPRSYHVGFSHGFNCGEAANFGTPQWLNVAKEAAVRRAAMNYLPMLSHQQLLYLLTMSFVSRQVTMVSLSYNLVPRSLLPGGRSSRLRDRQREEREFLVKRAFVEDILNENKNLSVLLREPGSRLVMWDPDLLPRHSALALAAAGVAGASAVSPPAVAKKELEEGHSELQNKEKTSLLEELSLFMEKLNDVYYDDDDGLLNDFQVDTGTLPCVACGVLGFPFMSVVQPSEKALKDLSERQGETDAQEIMTLSSEKSDCEWKTSSRYIRPRIFCLEHTIELQRLLQSRGGLKFLVICHKDFQKFKAHAAIVAEEVKVPFSYDDVLLESASQEELSLIDLAIEDEEKYEHSVDWTSELGINLRYCVKVRKNSPTKKIQHALSLGGLFSDTSQMLDFTTIRWLQRKSRSKAKPSSTSSFTPCEHLEVKADGKLRDNLDSQTGKKEEKIIQYSRKKKLNPKPSAEQVQELATLAKSKDFDKTCKNFSSRSHLDSAIRSEMNSEIGDSGRVIGVSFSINPCSSSFTVGHGQEHPEITVKFGSDLDGNVTNSLSMVNGDSADLTLTSISREQHQGHSMTSNNNGSNSGSHVVASQTILVSTGDNHDGPRKLSGDYVCSDVSVRGIQEAVEMSDQEFGEPRSTVTNIEDEQQSQIVKPTQREAVFGDHEQVEGAEAVSTRENLCSEIILHTEHSSAHVGMEIPDINTASENLVVDMTHDGEPLESSDILSSSNGDEASSNGLQVLNDELSMESEVSSSENTEVIEAPNSMGEAKKKRKIESESETNDNPESSIGFIRSPCEGLRSRGKRKATCETSLKHTETSDEEKKPIAKRLKKTPKACSGSRQQEVPTTTHPNRCYLEGCKMTFESKAKLQTHKRNRCTHEGCGKKFRAHKYLVLHQRVHKDERPFECSWKGCSMTFKWQWARTEHLRLHTGERPYICKVDGCGLSFRFVSDYSRHRRKTMHYVT

SEQ ID NO: 51494 - protein, 442 aa, Arabidopsis thaliana; identical to SEQ ID NO: 9718
  misc_feature: Useful for making plants with altered carbon content
  misc_feature: Useful for making plants with altered nitrogen content
  misc_feature: Useful for making plants with modulated carbon-nitrogen partitioning
  misc_feature: Useful for making plants with modulated nitrogen use efficiency

SEQ ID NO: 51495 - protein, 436 aa, Arabidopsis thaliana
  misc_feature: Useful for making plants with modulated oxidative stress sensitivity
MNSKNRINNVGEGVDIEIPDTAHQISSDSWFQAAFVLTTSINSAYVLGYSGTVMVPLGWIGGVVGLILATAISLYANTLVAKLHEFGGKRHIRYRDLAGFIYGRKAYCLTWVLQYVNLFMINCGFIILAGSALKAVYVLFRDDHAMKLPHFIAIAGLICAVFAIGIPHLSALGIWLAVSTILSLIYIVVAIVLSVKDGVKAPSRDYEIQGSPLSKLFTITGAAATLVFVFNTGMLPEIQATVKQPVVKNMMKALYFQFTVGVLPMFAVVFIGYWAYGSSTSPYLLNNVNGPLWVKALANISAILQSVISLHIFASPTYEYMDTKFGIKGNPLALKNLLFRIMARGGYIAVSTLLSALLPFLGDFMSLTGAVSTFPLTFILANHMYYKAKNNKLNTLQKLCHWLNVVFFSLMSVAAAIAALRLIALDSKNFHVFADL

SEQ ID NO: 51496 - protein, 511 aa, Arabidopsis thaliana
  misc_feature: Useful for making plants with altered cell wall content and/or composition
MSGKQQNHRSTSSRPRSKTLILIGSLFTVSLLVILYTSSSSSRASISNPNPSDRPETSFVTSLEHFLIYKAPKLSLPVRDDTVRGESDDDVRKLDEMVFERENRWLNEDPGYPVEFPIKVYVYEMPKKFTFDLLWLFHNTYKETSNATSNGSPVHRLIEQHSIDYWLWADLISPESERRLKSVVRVQKQQDADFFYVPFFTTISFFLLEKQQCKALYREALKWVTDQPAWKRSEGRDHIFPIHHPWSFKSVRKFVKNAIWLLPDMDSTGNWYKPGQVSLEKDLILPYVPNVDICDTKCLSESAPMRTTLLFFRGRLKRNAGGKIRAKLGAELSGIKDIIISEGTAGEGGKLAAQRGMRRSLFCLCPAGDTPSSARLFDAIVSGCIPVIVSDELEFPFEGILDYKKVAVLVSSSDAIQPGWLVNHLRSLTPFQVKGLQNNLAQYSRHFLYSSPAQPLGPEDLTWRMIAGKLVNIKLHTRRSQRVVKGSRSICRCDCWRSNSTASNSLSSLLS

SEQ ID NO: 51497 - protein, 305 aa, Arabidopsis thaliana
  misc_feature: Useful for making plants with altered cell wall content and/or composition
MVSSTLLVMSISLFLGLSILLVVHGKDFNQDIDITWGDGRGNILNNGTLLNLGLDQSSGSGFQSKAEYLYGKVDMQIKLVPGNSAGTVTTFYLKSQGLTWDEIDFEFLGNVSGDPYIVHTNVYTQGKGDREQQFYLWFDPTAAFHNYSILWNPSHIVFYIDGKPIREFKNLEVLGVAYPKNQPMRMYGSLWNADDWATRGGLVKTNWSQGPFVASFMNYNSENACVWSIVNGTTTTSPCSPGDSTSSSSSSTSEWFSQRGMDSSSKKVLRWVQRKFMVYNYCKDKKRFSNGLPVECTAKNKNTKS

SEQ ID NO: 51498 - protein, 377 aa, Arabidopsis thaliana
  misc_feature: Useful for making plants with modulated biotic stress sensitivity
  misc_feature: Useful for making plants with modulated flowering time
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 51499 - protein, 147 aa, Arabidopsis thaliana
  misc_feature: Useful for making plants with modulated nitrogen use efficiency
MVGLSIVLEMTNNNNNNNNNNNNKNPLSEGVLISPKVVNKANIIVTTAVTTDTTNLRRCYQDSGFLEHCFLCRRKLLPAKDIYMYKGDRAFCSVECRSKQMIMDEEESLRREYCSLMDVKKKKFDSPATAPSRYRRDPRNQAGGFAY

SEQ ID NO: 51500 - protein, 1026 aa, Arabidopsis thaliana
  misc_feature: Useful for making plants with altered cell wall content and/or composition
  misc_feature: Useful for making plants with modulated biomass
MEASAGLVAGSHNRNELVVIHNHEEPKPLKNLDGQFCEICGDQIGLTVEGDLFVACNECGFPACRPCYEYERREGTQNCPQCKTRYKRLRGSPRVEGDEDEEDIDDIEYEFNIEHEQDKHKHSAEAMLYGKMSYGRGPEDDENGRFPPVIAGGHSGEFPVGGGYGNGEHGLHKRVHPYPSSEAGSEGGWRERMDDWKLQHGNLGPEPDDDPEMGLIDEARQPLSRKVPIASSKINPYRMVIVARLVILAVFLRYRLLNPVHDALGLWLTSVICEIWFAVSWILDQFPKWFPIERETYLDRLSLRYEREGEPNMLAPVDVFVSTVDPLKEPPLVTSNTVLSILAMDYPVEKISCYVSDDGASMLTFESLSETAEFARKWVPFCKKFSIEPRAPEMYFTLKVDYLQDKVHPTFVKERRAMKREYEEFKVRINAQVAKASKVPLEGWIMQDGTPWPGNNTKDHPGMIQVFLGHSGGFDVEGHELPRLVYVSREKRPGFQHHKKAGAMNALVRVAGVLTNAPFMLNLDCDHYVNNSKAVREAMCFLMDPQIGKKVCYVQFPQRFDGIDTNDRYANRNTVFFDINMKGLDGIQGPVYVGTGCVFKRQALYGYEPPKGPKRPKMISCGCCPCFGRRRKNKKFSKNDMNGDVAALGGAEGDKEHLMSEMNFEKTFGQSSIFVTSTLMEEGGVPPSSSPAVLLKEAIHVISCGYEDKTEWGTELGWIYGSITEDILTGFKMHCRGWRSIYCMPKRPAFKGSAPINLSDRLNQVLRWALGSVEIFFSRHSPLWYGYKGGKLKWLERFAYANTTIYPFTSIPLLAYCILPAICLLTDKFIMPPISTFASLFFISLFMSIIVTGILELRWSGVSIEEWWRNEQFWVIGGISAHLFAVVQGLLKILAGIDTNFTVTSKATDDDDFGELYAFKWTTLLIPPTTVLIINIVGVVAGISDAINNGYQSWGPLFGKLFFSFWVIVHLYPFLKGLMGRQNRTPTIVVIWSVLLASIFSLLWVRIDPFVLKTKGPDTSKCGINC

SEQ ID NO: 51501 - protein, 115 aa, Arabidopsis thaliana
  misc_feature: Useful for making plants with modulated biomass
  misc_feature: Useful for making plants with modulated flowering time
MFFAHVSGCNTCFPPTPIPNLNPISNPTTPSCSRDAIKLGVCAKILDVAVGTVIGNPSDTLCCSVLQGLVDLDAAVCLCTTIKANILGINIDLPISLSLLINTCGKKLPSDCICA

SEQ ID NO: 51502 - protein, 285 aa, Arabidopsis thaliana
  misc_feature: Useful for making plants with altered cell wall content and/or composition
MAAFATKQSPLLLASLLILIGVATGSFYDSFDITWGAGRANIFESGQLLTCTLDKTSGSGFQSKKEYLFGKIDMKIKLVPGNSAGTVTAYYLSSKGETWDEIDFEFLGNVTGQPYVIHTNVFTGGKGNREMQFYLWFDPTADFHTYTVLWNPLNIIFLVDGIPIRVFKNNEANGVAYPKSQPMKIYSSLWEADDWATQGGKVKTDWTNAPFSASYRSFNDVDCCSRTSIWNWVTCNANSNSWMWTTLNSNQLGQLKWVQKDYMIYNYCTDFKRFPQGLPTECNLN

SEQ ID NO: 51503 - protein, 199 aa, Arabidopsis thaliana
  misc_feature: Useful for making plants with modulated biomass
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 51504 - protein, 189 aa, Glycine max
  misc_feature: Useful for making plants with modulated biomass
  misc_feature: Useful for making plants with modulated flowering time
MVQSRKFRGVRQRNWGSWVSEIRHPLLKRRVWLGTFETADEAARAYDEAAILMSGRNAKTNFPVGENQMGNHSSSTSSSSTTTLSAVLSAKLRKCCKSPSPSLTCLRLDTENSHIGVWQKRAGPRSDSNWIMMVELEKKNNKGPSSESELPVVVVDDDAPEKVKPEESTGLDEEQKMALQMIEELLNRN

SEQ ID NO: 51505 - protein, 181 aa, Arabidopsis thaliana
  misc_feature: Useful for making plants with altered lignin content
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEARRRLRRWRNRYMRLRDIRELHR

SEQ ID NO: 51506 - protein, 428 aa, Arabidopsis thaliana
  misc_feature: Useful for making plants with modulated nitrogen use efficiency
MSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDDSCIRISYATSLDVLQAAVEKIRKALEPLRATVSV

SEQ ID NO: 51507 - protein, 697 aa, Arabidopsis thaliana
  misc_feature: Useful for making plants with altered cell wall content and/or composition
MAMTSWPSTGRQRRHQLASMLLLVLVVVGIYVPVFALLPSLSYTPQSLPSAIPQDEKMISRKFYIKDDNFWKDGNRFQIIGGDLHYFRVLPEYWEDRLLRANALGLNTIQVYVPWNLHEPKPGKMVFEGIGDLVSFLKLCEKLDFLVMLRAGPYICGEWDLGGFPAWLLAVKPRLQLRTSDPVYLKLVERWWDVLLPKVFPLLYSNGGPVIMVQIENEYGSYGNDKAYLRKLVSMARGHLGDDIIVYTTDGGTKETLDKGTVPVADVYSAVDFSTGDDPWPIFKLQKKFNAPGRSPPLSSEFYTGWLTHWGEKITKTDAEFTAASLEKILSRNGSAVLYMVHGGTNFGFYNGANTGSEESDYKPDLTSYDYDAPIKESGDIDNPKFQALQRVIKKYNASPHPISPSNKQRKAYGSIKMQMTTSLFDLVRMTDPADVITSANPISMESVGQMFGFLLYESSYIAKKSGNTLRIPKVHDRAQVFVSCLSQDVDVGVLRYIGTTERWNNQPISLPTIECTTNTSLFILVENMGRVNYGPYIFDDKGILSSVYLDGQILHGWKMIPIPFHNLNQEPNLTFEMQHTKNRSKKFELTNDVGRKEPALFAGEFSINSEEEIKDTYLSFNGWGKGVAFVNEFNIGRYWPSVGPQCNLYVPAPLLKRGKNTLVVFELESPHLELSLEAVDHQDFTCGSNVSKVNQL

SEQ ID NO: 51508 - protein, 53 aa, Panicum virgatum; identical to SEQ ID NO: 35942
  misc_feature: Useful for making plants with altered carbohydrate content

SEQ ID NO: 51509 - protein, 75 aa, Arabidopsis thaliana
  misc_feature: Useful for making plants with altered cell wall content and/or composition
MTLPPGLYSGTSSLALVARASAFGLGLVYGNMKLKVLKPPLIIKPLFFLYNKMPKAGGDVSPVSLISSFMIHPLA

SEQ ID NO: 51510 - protein, 419 aa, Glycine max
  misc_feature: Useful for making plants with modulated cold sensitivity
MARAVLKENDTVFANRDVPAAGRAASYGGSDIVWTPYGPEWRMLRKVCVAKMLSHATLDTVYDLRREEVRKTVSYLHDRVGSAVNIGEQVFLTVINVITNMLWGGVVEGAERESMGAEFRELVAEMTQLLGKPNVSDFFPGLARFDLQGVEKQMNALVPRFDGIFERMIGERKKVELEGAERMDFLQFLLKLKEEGGDAKTPLTITHVKALLMDMVVGGTDTSSNTIEFAMAEMMHNPEIMKRVQEELEVVVGKDNTVEESHIHKLSYLQAVMKETLRLHPVLPLLVPHCPSETTIVGGYTIPKGSRVFVNVWAIHRDPSIWKKSLEFDPTRFLDAKLDFSGNDFNYFPFGSGRRICAGIAMAEKTVLHFLATLVHLFDWTVPQGEKLEVSEKFGIVLKKKIPLVAIPTPRLSNPDLYQ

SEQ ID NO: 51511 - protein, 2325 aa, Zea mays
  misc_feature: Useful for making plants with altered oil content
  misc_feature: Useful for making plants with modulated herbicide sensitivity
MSQLGLAAAASKALPLLPNRQRSSAGTTFSSSSLSRPLNRRKSHTRSLRDGGDGVSDAKKHSQSVRQGLAGIIDLPSEAPSEVDISHGSEDPRGPTDSYQMNGIINETHNGRHASVSKVVEFCAALGGKTPIHSILVANNGMAAAKFMRSVRTWANDTFGSEKAIQLIAMATPEDMRINAEHIRIADQFVEVPGGTNNNNYANVQLIVGMAQKLGVSAVWPGWGHASENPELPDALTAKGIVFLGPPASSMNALGDKVGSALIAQAAGVPTLAWSGSHVEVPLECCLDAIPEEMYRKACVTTTEEAVASCQVVGYPAMIKASWGGGGKGIRKVHNDDEVRALFKQVQGEVPGSPIFVMRLASQSRHLEVQLLCDQYGNVAALHSRDCSVQRRHQKIIEEGPVTVAPRETVKALEQAARRLAKAVGYVGAATVEYLYSMETGDYYFLELNPRLQVEHPVTEWIAEVNLPAAQVAVGMGIPLWQIPEIRRFYGMDYGGGYDIWRKTAALATPFNFDEVDSQWPKGHCVAVRITSEDPDDGFKPTGGKVKEISFKSKPNVWAYFSVKSGGGIHEFADSQFGHAFAYGLSRPAAITNMSLALKEIQIRGEIHSNVDYTVDLLNASDFRENKIHTGWLDTRIAMRVQAERPPWYISVVGGALYKTVTTNAATVSEYVSYLTKGHIPPKHISLVNSTVNLNIEGSKYTIETVRTGHGSYRLRMNDSTVEANVQSLCDGGLLMQLDGNSHVIYAEEEAGGTRLQIDGKTCLLQNDHDPSKLLAETPCKLLRFLVADGAHVDADVPYAEVEVMKMCMPLLSPASGVIHCMMSEGQALQAGDLIARLDLDDPSAVKRAEPFDGIFPQMELPVAVSSQVHKRYAASLNAARMVLAGYEHNINEVVQDLVCCLDNPELPFLQWDELMSVLATRLPRNLKSELEDKYKEYKLNFYHGKNEDFPSKLLRDIIEENLSYGSEKEKATNERLVEPLMNLLKSYEGGRESHAHFVVKSLFEEYLTVEELFSDGIQSDVIETLRHQHSKDLQKVVDIVLSHQGVRNKAKLVTALMEKLVYPNPGGYRDLLVRFSSLNHKRYYKLALKASELLEQTKLSELRASVARSLSDLGMHKGEMSIKDNMEDLVSAPLPVEDALISLFDYSDRTVQQKVIETYISRLYQPHLVKDSIQMKFKESGAITFWEFYEGHVDTRNGHGAIIGGKRWGAMVVLKSLESASTAIVAALKDSAQFNSSEGNMMHIALLSAENESNISGISSDDQAQHKMEKLSKILKDTSVASDLQAAGLKVISCIVQRDEARMPMRHTFLWLDDKSCYEEEQILRHVEPPLSTLLELDKLKVKGYNEMKYTPSRDRQWHIYTLRNTENPKMLHRVFFRTIVRQPNAGNKFRSAQISDAEVGCPEESLSFTSNSILRSLMTAIEELELHAIRTGHSHMYLCILKEQKLLDLIPFSGSTIVDVGQDEATACSLLKSMALKIHELVGARMHHLSVCQWEVKLKLDCDGPASGTWRVVTTNVTGHTCTIDIYREVEEIESQKLVYHSASSSAGPLHGVALNNPYQPLSVIDLKRCSARNNRTTYCYDFPLAFETALQKSWQSNGSTVSEGNENSKSYVKATELVFAEKHGSWGTPIIPMERPAGLNDIGMVAWIMEMSTPEFPNGRQIIVVANDITFRAGSFGPREDAFFETVTNLACERKLPLIYLAANSGARIGIADEVKSCFRVGWSDEGSPERGFQYIYLTEEDYARISSSVIAHKLELDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVPDVLEGVSNILRWLSYVPANIGGPLPITKPLDPPDRPVAYIPENTCDPRAAICGVDDSQGKWLGGMFDKDSFVETFEGWAKTVVTGRAKLGGIPVGVIAVETQTMMQIIPADPGQLDSHERSVPRAGQVWFPDSATKTAQALLDFNREGLPLFILANWRGFSGGQRDLFEGILQAGSTIVENLRTYNQPAFVYIPMAGELRGGAWVVVDSKINPDRIECYAERTAKGNVLEPQGLIEIKFRSEELQDCMGRLDPELINLKAKLQDVNHGNGSLPDIEGIRKSIEARTKQLLPLYTQIAIRFAELHDTSLRMAAKGVIKKVVDWEESRSFFYKRLRRRIAEDVLAKEIRQIVGDKFTHQLAMELIKEWYLASQATTGSTGWDDDDAFVAWKDSPENYKGHIQKLRAQKVSHSLSDLADSSSDLQAFSQGLSTLLDKMDPSQRAKFVQEVKKVLD

SEQ ID NO: 51512 - protein, 1112 aa, Arabidopsis thaliana
  misc_feature: Useful for making plants with altered low light response
  misc_feature: Useful for making plants with modulated biomass
  misc_feature: Useful for making plants with modulated flowering time
  misc_feature: Useful for making plants with modulated nitrogen use efficiency
MGFESSSSAASNMKPQPQKSNTAQYSVDAALFADFAQSIYTGKSFNYSKSVISPPNHVPDEHITAYLSNIQRGGLVQPFGCLIAVEEPSFRILGLSDNSSDFLGLLSLPSTSHSGEFDKVKGLIGIDARTLFTPSSGASLSKAASFTEISLLNPVLVHSRTTQKPFYAILHRIDAGIVMDLEPAKSGDPALTLAGAVQSQKLAVRAISRLQSLPGGDIGALCDTVVEDVQRLTGYDRVMVYQFHEDDHGEVVSEIRRSDLEPYLGLHYPATDIPQAARFLFKQNRVRMICDCNATPVKVVQSEELKRPLCLVNSTLRAPHGCHTQYMANMGSVASLALAIVVKGKDSSKLWGLVVGHHCSPRYVPFPLRYACEFLMQAFGLQLQMELQLASQLAEKKAMRTQTLLCDMLLRDTVSAIVTQSPGIMDLVKCDGAALYYKGKCWLVGVTPNESQVKDLVNWLVENHGDDSTGLTTDSLVDAGYPGAISLGDAVCGVAAAEFSSKDYLLWFRSNTASAIKWGGAKHHPKDKDDAGRMHPRSSFTAFLEVAKSRSLPWEISEIDAIHSLRLIMRESFTSSRPVLSGNGVARDANELTSFVCEMVRVIETATAPIFGVDSSGCINGWNKKTAEMTGLLASEAMGKSLADEIVQEESRAALESLLCKALQGEEEKSVMLKLRKFGQNNHPDYSSDVCVLVNSCTSRDYTENIIGVCFVGQDITSEKAITDRFIRLQGDYKTIVQSLNPLIPPIFASDENACCSEWNAAMEKLTGWSKHEVIGKMLPGEVFGVFCKVKCQDSLTKFLISLYQGIAGDNVPESSLVEFFNKEGKYIEASLTANKSTNIEGKVIRCFFFLQIINKESGLSCPELKESAQSLNELTYVRQEIKNPLNGIRFAHKLLESSEISASQRQFLETSDACEKQITTIIESTDLKSIEEGKLQLETEEFRLENILDTIISQVMIILRERNSQLRVEVAEEIKTLPLNGDRVKLQLILADLLRNIVNHAPFPNSWVGISISPGQELSRDNGRYIHLQFRMIHPGKGLPSEMLSDMFETRDGWVTPDGLGLKLSRKLLEQMNGRVSYVREDERCFFQVDLQVKTMLGVESRGTEGSSSIK

SEQ ID NO: 51513 - protein, 316 aa, Arabidopsis thaliana
  misc_feature: Useful for making plants with modulated nitrogen use efficiency
MGFLRCLQLLLLLFLSLRLQKLSAQSSSPNASSSSSLDALLQDYSFRALLRPRTGILYEATTVPSNLTGIKLAAMRLRSGSFRKRGVTPFNEFSIPSGVIVKPYVTRLVLVYQNLANFSHLYYPLSGYDYVAPVLGLLAYDAKNLSALNLPQLDLRVSNDPIRIDFSDLERIPQGSSAKCVRFDSKGEASFSDSIQPGNTCETEHQGHFSVVVKSVASAPSLAPPGIESKKKKKSSDSNSKTWIIVGSVVGGLILLGLLLFLVLRCRNYKKQEKMREMERAGETGEALRMTQVGETRAPTATTTRTQPMLETEYAA

SEQ ID NO: 51514 - protein, 850 aa, Arabidopsis thaliana
  misc_feature: Useful for making plants with altered cell wall content and/or composition
MAMISFSFPSPAKLPIKSQPSVSNRINVADRLILRHLNAGDLRGAVSALDLMARDGIRPMDSVTFSSLLKSCIRARDFRLGKLVHARLIEFDIEPDSVLYNSLISLYSKSGDSAKAEDVFETMRRFGKRDVVSWSAMMACYGNNGRELDAIKVFVEFLELGLVPNDYCYTAVIRACSNSDFVGVGRVTLGFLMKTGHFESDVCVGCSLIDMFVKGENSFENAYKVFDKMSELNVVTWTLMITRCMQMGFPREAIRFFLDMVLSGFESDKFTLSSVFSACAELENLSLGKQLHSWAIRSGLVDDVECSLVDMYAKCSADGSVDDCRKVFDRMEDHSVMSWTALITGYMKNCNLATEAINLFSEMITQGHVEPNHFTFSSAFKACGNLSDPRVGKQVLGQAFKRGLASNSSVANSVISMFVKSDRMEDAQRAFESLSEKNLVSYNTFLDGTCRNLNFEQAFKLLSEITERELGVSAFTFASLLSGVANVGSIRKGEQIHSQVVKLGLSCNQPVCNALISMYSKCGSIDTASRVFNFMENRNVISWTSMITGFAKHGFAIRVLETFNQMIEEGVKPNEVTYVAILSACSHVGLVSEGWRHFNSMYEDHKIKPKMEHYACMVDLLCRAGLLTDAFEFINTMPFQADVLVWRTFLGACRVHSNTELGKLAARKILELDPNEPAAYIQLSNIYACAGKWEESTEMRRKMKERNLVKEGGCSWIEVGDKIHKFYVGDTAHPNAHQIYDELDRLITEIKRCGYVPDTDLVLHKLEEENDEAEKERLLYQHSEKIAVAFGLISTSKSRPVRVFKNLRVCGDCHNAMKYISTVSGREIVLRDLNRFHHFKDGKCSCNDYW

SEQ ID NO: 51515 - protein, 261 aa, Arabidopsis thaliana
  misc_feature: Useful for biocontainment applications
MVFKSEKSNREMKSKEKQRKGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKKGVTLKQHETTKKHQTPLITNSLEALQSSTERSSSSINVGETSNAQTSSFSPNLVFSEWLDHSLLMDQSPQKSSYVQNLVLPEERGFIGPCGPRYLGNDSLPDFVPNSEFLLDDEISSEIEFCTSFSDNFLFDGLINELRPM

SEQ ID NO: 51516 - protein, 887 aa, Arabidopsis thaliana
  misc_feature: Useful for making plants with altered cell wall content and/or composition
MAESIRTFSLQWRILSLIIALLVYFPILSGSYFKPFNVSYDHRALIIAGKRRMLVSAGIHYPRATPEMWSDLIAKSKEGGADVVQTYVFWNGHEPVKGQYNFEGRYDLVKFVKLIGSSGLYLHLRIGPYVCAEWNFGGFPVWLRDIPGIEFRTDNEPFKKEMQKFVTKIVDLMREAKLFCWQGGPIIMLQIENEYGDVEKSYGQKGKDYVKWAASMALGLGAGVPWVMCKQTDAPENIIDACNGYYCDGFKPNSRTKPVLWTEDWDGWYTKWGGSLPHRPAEDLAFAVARFYQRGGSFQNYYMYFGGTNFGRTSGGPFYITSYDYDAPLDEYGLRSEPKWGHLKDLHAAIKLCEPALVAADAPQYRKLGSKQEAHIYHGDGETGGKVCAAFLANIDEHKSAHVKFNGQSYTLPPWSVSILPDCRHVAFNTAKVGAQTSVKTVESARPSLGSMSILQKVVRQDNVSYISKSWMALKEPIGIWGENNFTFQGLLEHLNVTKDRSDYLWHKTRISVSEDDISFWKKNGPNSTVSIDSMRDVLRVFVNKQLAGSIVGHWVKAVQPVRFIQGNNDLLLLTQTVGLQNYGAFLEKDGAGFRGKAKLTGFKNGDLDLSKSSWTYQVGLKGEADKIYTVEHNEKAEWSTLETDASPSIFMWYKTYFDPPAGTDPVVLNLESMGRGQAWVNGQHIGRYWNIISQKDGCDRTCDYRGAYNSDKCTTNCGKPTQTRYHVPRSWLKPSSNLLVLFEETGGNPFKISVKTVTAGILCGQVSESHYPPLRKWSTPDYINGTMSINSVAPEVHLHCEDGHVISSIEFASYGTPRGSCDGFSIGKCHASNSLSIVSEACKGRNSCFIEVSNTAFISDPCSGTLKTLAVMSRCSPSQNMSDLSF

SEQ ID NO: 51517 - protein, 162 aa, Triticum aestivum; identical to SEQ ID NO: 9665
  misc_feature: Useful for making plants with modulated biomass

SEQ ID NO: 51518 - protein, 294 aa, Arabidopsis thaliana [sequence omitted]

SEQ ID NO: 51519 - protein, 203 aa, Glycine max
  misc_feature: Useful for making plants with altered lignin content
MYGQSCYESDLALLDSIRRHLLGDSEEHRFGAPNVNSGSTPLYSRSSSFGRLYPCLSNDWGELPLMEDDSEDMLLYGVLRDAVNVGWVPSLDASSPESFSSAFMPPVTVKSETDLFPAPEPICNPPVVQGPAPAVVPAKGKHYRGVRQRPWGKFAAEIRDPAKNGARVWLGTFETAEDAALAYGSSRVSNARLAGFVEFSAPD

SEQ ID NO: 51520 - protein, 184 aa, Glycine max
  misc_feature: Useful for making plants with altered lignin content
  misc_feature: Useful for making plants with modulated biomass
MDHQPPPCPAAASATDNPRGGTRHPMYRGVRKRRWGKWVSEIREPRKKNRIWLGSFPVPEMAARAYDVAAYCLKGRKAQLNFPDDVDSLPLPSSRTARDIQTAAAQAARMMKASGNDEKSGIASDDGDSGCDDFWGEIELPELMDGECYWGCPAGASSWTSSGDLAEWPEEELSPQQPSFMACL

SEQ ID NO: 51521 - protein, 61 aa, Arabidopsis thaliana
  misc_feature: Useful for making plants with altered cell wall content and/or composition
MEMKKIACGVLFAAASMTAVMAAEEVGAPAPGPASAASAALPALGSLVGASLVSLFSYYLH

SEQ ID NO: 51522 - protein, 502 aa, Arabidopsis thaliana
  misc_feature: Useful for making plants with altered carbon content
  misc_feature: Useful for making plants with altered nitrogen content
  misc_feature: Useful for making plants with modulated carbon-nitrogen partitioning
MEVEGKGGEAGTTTTTAPRRFALPVDAENKATTFRLFSVAKPHMRAFHLSWFQFFCCFVSTFAAPPLLPVIRENLNLTATDIGNAGIASVSGAVFARIVMGTACDLFGPRLASAALTLSTAPAVYFTAGIKSPIGFIMVRFFAGFSLATFVSTQFWMSSMFSGPVVGSANGIAAGWGNLGGGATQLIMPIVFSLIRNMGATKFTAWRIAFFIPGLFQTLSAFAVLLFGQDLPDGDYWAMHKSGEREKDDVGKVISNGIKNYRGWITALAYGYCFGVELTIDNIIAEYFFDRFHLKLQTAGIIAASFGLANFFARPGGGIFSDFMSRRFGMRGRLWAWWIVQTSGGVLCACLGQISSLTVSIIVMLVFSVFVQAACGLTFGVVPFISRRSLGVVSGMTGAGGNVGAVLTQLIFFKGSTYTRETGITLMGVMSIACSLPICLIYFPQWGGMFCGPSSKKVTEEDYYLAEWNDEEKEKNLHIGSQKFAETSISERGRATTTHPQT

SEQ ID NO: 51523 - protein, 542 aa, Panicum virgatum; identical to SEQ ID NO: 1780
  misc_feature: Useful for making plants with altered carbohydrate content

SEQ ID NO: 51524 - protein, 204 aa, Panicum virgatum
  misc_feature: Useful for making plants with altered carbohydrate content
MRGDPKPPPRRSPAAPTLAGRLRKHSTSLLLLLLWFALSLYLFISPTPPAAAPLRRSAFLRSKARALSATTAGAPPVRIYVYDLPARFNRDWVAADARCARHLFAAEVAVHEALLAYAGRAARPDDADLFFVPVYVSCNFSTPNGFPSLSHARGLLADAVHLLRTQMPYWNRSAGADHIFVASHDFGACFHPMVSHLFVACCAR

SEQ ID NO: 51525 - protein, 361 aa, Arabidopsis thaliana
  misc_feature: Useful for making plants with altered cell wall content and/or composition
MKIYVYDLPASYNDDWVTASDRCASHLFAAEVAIHRALLSSDVRTLDPDEADYFFVPVYVSCNFSTSNGFPSLSHARSLLSSAVDFLSDHYPFWNRSQGSDHVFVASHDFGACFHAMEDMAIEEGIPKFMKRSIILQTFGVKYKHPCQEVEHVVIPPYIPPESVQKAIEKAPVNGRRDIWAFFRGKMEVNPKNISGRFYSKGVRTAILKKFGGRRRFYLNRHRFAGYRSEIVRSVFCLCPLGWAPWSPRLVESAVLGCVPVVIADGIQLPFSETVQWPEISLTVAEKDVRNLRKVLEHVAATNLSAIQRNLHEPVFKRALLYNVPMKEGDATWHILESLWRKLDDRSYRRSRVLSQREVDM

SEQ ID NO: 51526 - protein, 1889 aa, Arabidopsis thaliana
  misc_feature: Useful for making plants with altered cell wall content and/or composition
MSATRGGPDQGPSQPQQRRIIRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKFILSFVLIVPSQLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLVNVLPVLDNKEEDRDHVVILFQDMLEVVTRDIMMEDYNISRLATFYRTAMACHSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPGDFCSYAVNVAYILESRLEPDLLSPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGLWSIMAGDFLDIVCDEDCFGWKAEIQREFSADVPVDKGADIHDVYRNYCDIDHTGSHDDTRHNCVYPCLYAHRLGDALDCASV

SEQ ID NO: 51527 - protein, 521 aa, Arabidopsis thaliana
  misc_feature: Useful for making plants with modulated carbohydrate content
  misc_feature: Useful for making plants with modulated phosphate use efficiency
MADQQLGVLKALDVAKTQLYHFTAIVIAGMGFFTDAYDLFCVSLVTKLLGRLYYFNPTSAKPGSLPPHVAAAVNGVALCGTLAGQLFFGWLGDKLGRKKVYGITLIMMILCSVASGLSLGNSAKGVMTTLCFFRFWLGFGIGGDYPLSATIMSEYANKKTRGAFIAAVFAMQGVGILAGGFVALAVSSIFDKKFPSPTYEQDRFLSTPPQADYIWRIIVMFGALPAALTYYWRMKMPETARYTALVAKNIKQATADMSKVLQTDLELEERVEDDVKDPKKNYGLFSKEFLRRHGLHLLGTTSTWFLLDIAFYSQNLFQKDIFSAIGWIPKAATMNAIHEVFKIARAQTLIALCSTVPGYWFTVAFIDIIGRFAIQLMGFFMMTVFMFAIAFPYNHWILPDNRIGFVVMYSLTFFFANFGPNATTFIVPAEIFPARLRSTCHGISAATGKAGAIVGAFGFLYAAQPQDKTKTDAGYPPGIGVKNSLIMLGVINFVGMLFTFLVPEPKGKSLEELSGEAEVDK

SEQ ID NO: 51528 - protein, 322 aa, Arabidopsis thaliana
  misc_feature: Useful for making plants with altered cell wall content and/or composition
MAFSKGLIFAMIFAVLAIVKPSEAALDAHYYDQSCPAAEKIILETVRNATLYDPKVPARLLRMFFHDCFIRGCDASILLDSTRSNQAEKDGPPNISVRSFYVIEDAKRKLEKACPRTVSCADVIAIAARDVVTLSGGPYWSVLKGRKDGTISRANETRNLPPPTFNVSQLIQSFAARGLSVKDMVTLSGGHTIGFSHCSSFESRLQNFSKFHDIDPSMNYAFAQTLKKKCPRTSNRGKNAGTVLDSTSSVFDNVYYKQILSGKGVFGSDQALLGDSRTKWIVETFAQDQKAFFREFAASMVKLGNFGVKETGQVRVNTRFVN

SEQ ID NO: 51529 - protein, 107 aa, Arabidopsis thaliana
  misc_feature: Useful for making plants with modulated heat sensitivity
MENKSPSKKNKPPSCGSLVTILSLDGGGVRGIIAGVILAFLEKQLQELDGEEARLADYFDVIAGTSTGGLVTAMLTVPDETGRPHFAAKDIVPFYLEHCPKIFPQPT

SEQ ID NO: 51530 - protein, 182 aa, Arabidopsis thaliana
  misc_feature: Useful for making plants with modulated low light sensitivity
  misc_feature: Useful for making plants with modulated nitrogen use efficiency
MEGETAAKAAASSSSSPSRYESQKRRDWNTFLQYLRNHKPPLNLSRCSGAHVLEFLKYLDQFGKTKVHATACPFFGQPNPPSQCTCPLKQAWGSLDALIGRLRAAFEEIGGGLPESNPFAAKAVRIYLKEVRQTQAKARGIPYDKKKRKRPHTDTATPIAGDGDDAEGSGGAALVVTAATTV

SEQ ID NO: 51531 - protein, 293 aa, Arabidopsis thaliana; identical to SEQ ID NO: 9605
  misc_feature: Useful for making plants with altered alkaloid content
  misc_feature: Useful for making plants with altered terpenoid content

SEQ ID NO: 51532 - protein, 226 aa, Arabidopsis thaliana
  misc_feature: Useful for making plants with altered lignin content
MVSPENTNWLSDYPLIEGAFSDQNPTFPWQIDGSATVSVEVDGFLCDADVIKEPSSRKRIKTESCTGSNSKACREKQRRDRLNDKFTELSSVLEPGRTPKTDKVAIINDAIRMVNQARDEAQKLKDLNSSLQEKIKELKDEKNELRDEKQKLKVEKERIDQQLKAIKTQPQPQPCFLPNPQTLSQAQAPGSKLVPFTTYPGFAMWQFMPPAAVDTSQDHVLRPPVA

SEQ ID NO: 51533 - protein, 240 aa, Arabidopsis thaliana
  misc_feature: Useful for making plants with altered alkaloid content
MQSSSSSGGDDLEKQQQQQQKDKSPQKQSESANESNHLTIVVCNGDSSREELVGQIPPEKEVSLSRNGSSHEQCRVCLQDKEEVLIELGCQCRGGLAKAHRSCIDAWFRTKGSNQCEICQVVAVNVTPPETQPTTNYWVWRIDPSYRQEERERGCFSPLWVAFSILIGGLMLDVLISITLGVSALPVNIIIGVIVVLGLGTALRLTLEFCYEWSLRRAVHRAVQRAEANNFSNIAYPPAL

SEQ ID NO: 51534 - protein, 330 aa, Arabidopsis thaliana
  misc_feature: Useful for making plants with altered cell wall content and/or composition
MAKKMSSLIIIFNILLLLTTQTHAHNVTRLLANHPSFSSFSHFLTQTHLADEINRRRTITVCAVDNAAMSALTSKGYTLSTLKNILSLHVLLDYFGTKKLHQIRDGSALAATLFQATGAAPGTSGFVNITDLRGGKVGFGPDGGDLSSFFVKSIEEVPYNISIIQISRVLPSETAAAPTPAPAEMNLTGIMSAHGCKVFAETLLTNPGASKTYQESLEGGMTVFCPGDDAMKGFLPKYKNLTAPKKEAFLDFLAVPTYYSMAMLKSNNGPMNTLATDGANKFELTVQNDGEKVTLKTRINTVKIVDTLIDEQPLAIYATDKVLLPKELFK

SEQ ID NO: 51535 - protein, 758 aa, Arabidopsis thaliana
  misc_feature: Useful for making plants with modulated heat sensitivity
MIFKIEDVTVYFPYDNIYPEQYEYMVELKRALDAKGHCLLEMPTGTGKTIALLSLITSYRLSRPDSPIKLVYCTRTVHEMEKTLGELKLLHDYQVRHLGTQAKILALGLSSRKNLCVNTKVLAAENRDSVDAACRKRTASWVRALSTENPNVELCDFFENYEKAAENALLPPGVYTLEDLRAFGKNRGWCPYFLARHMIQFANVIVYSYQYLLDPKVAGFISKELQKESVVVFDEAHNIDNVCIEALSVSVRRVTLEGANRNLNKIRQEIDRFKATDAGRLRAEYNRLVEGLALRGDLSGGDQWLANPALPHDILKEAVPGNIRRAEHFVHVLRRLLQYLGVRLDTENVEKESPVSFVSSLNSQAGIEQKTLKFCYDRLQSLMLTLEITDTDEFLPIQTVCDFATLVGTYARGFSIIIEPYDERMPHIPDPILQLSCHDASLAIKPVFDRFQSVVITSGTLSPIDLYPRLLNFTPVVSRSFKMSMTRDCICPMVLTRGSDQLPVSTKFDMRSDPGVVRNYGKLLVEMVSIVPDGVVCFFVSYSYMDGIIATWNETGILKEIMQQKLVFIETQDVVETTLALDNYRRACDCGRGAVFFSVARGKVAEGIDFDRHYGRLVVMYGVPFQYTLSKILRARLEYLHDTFQIKEGDFLTFDALRQAAQCVGRVIRSKADYGMMIFADKRYSRHDKRSKLPGWILSHLRDAHLNLSTDMAIHIAREFLRKMAQPYDKAGTMGRKTLLTQEDLEKMAETGVQDMAY

SEQ ID NO: 51536 - protein, 488 aa, Arabidopsis thaliana
  misc_feature: Useful for making plants with modulated nitrogen use efficiency
MAMLGAQQVPAAACTPDMVGNAFVPQYYHILHQSPEHVHRFYQEISKLGRPEENGLMSITSTLQAIDKKIMALGYGVISAEIATVDTQESHGGGYIVLVTGYLTGKDSVRRTFSQTFFLAPQETGYFVLNDMFRFIDEGTVVHGNQIPVNNVQAPVNTYQDTAAAKEIPDDFVQEKYVQENHAVKQTEVLSKSINEPEKVFTPSEDEQVSAAEEVLVTETVNEAPIEVQKVGESDSRTGEIPKRSYASIVKVMKENAAPMSASRTPTKVEPKKQEDQAIHIPLPTPLSEKSDSGANVAVNENNQENERALGPSIYLKGLPLDATPALLENEFQKFGLIRTNGIQVRSQKGFCFGFVEFESASSMQSAIEASPVMLNGHKVVVEEKRSTARGNYRGRSTFGVNTGYRNEGGRGRGSFGGGRGGYGRTDFNGYGNNRGNNRGGYANRANGDGGGFPRANGNNGRVRRGGGIDANRATKPVDDAPHVSVTA

SEQ ID NO: 51537 - protein, 332 aa, Arabidopsis thaliana
  misc_feature: Useful for making plants with altered cell wall content and/or composition
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYESVKSLQEKGHLPLPQDSNQNEVIIES

SEQ ID NO: 51538 - protein, 329 aa, Arabidopsis thaliana; identical to SEQ ID NO: 9690
  misc_feature: Useful for making plants with altered carotene content

SEQ ID NO: 51539 - protein, 371 aa, Panicum virgatum; identical to SEQ ID NO: 8108
  misc_feature: Useful for making plants with altered carbohydrate content

SEQ ID NO: 51540 - protein, 361 aa, Arabidopsis thaliana
  misc_feature: Useful for making plants with modulated salt sensitivity
MALEEEEESQNAPFCVLDGLFCEEESEFHEQVDLCDESVEKFPFLNLGLSDHDMLWDDDELSTLISKQEPCLYDEILDDEFLVLCREKALDWIFKVKSHYGFNSLTALLAVNYFDRFITSRKFQTDKPWMSQLTALACLSLAAKVEEIRVPFLLDFQVEEARYVFEAKTIQRMELLVLSTLDWRMHPVTPISFFDHIIRRYSFKSHHQLEFLSRCESLLLSIIPDSRFLSFSPSVLATAIMVSVIRDLKMCDEAVYQSQLMTLLKVDSEKVNKCYELVLDHSPSKKRMMNWMQQPASPIGVFDASFSSDSSNESWVVSASASVSSSPSSEPLLKRRRVQEQQMRLSSINRMFFDVLSSSPR

SEQ ID NO: 51541 - protein, 485 aa, Arabidopsis thaliana; identical to SEQ ID NO: 9464
  misc_feature: Useful for making plants with modulated low light sensitivity

SEQ ID NO: 51542 - protein, 260 aa, Arabidopsis thaliana
  misc_feature: Useful for making plants with modulated light quality sensitivity
  misc_feature (18)..(18): Xaa is any aa, unknown, or other
MDIEQKQAEIIDQLVKRXSTCKSEALGPLIIEATSHPSLFAFSEILALPNVAQLEGTTDSVYLDLLRLFAHGTWGDYKCNATRLPHLSPDQILKLKQLTVLTLAESNKVLPYDTLMVELDVSNVRELEDFLINECMYAGIVRGKLDQLKRCFEVPFAAGRDLRPGQLGNMLHTLSNWLNTSENLLISIQDKIKWADNMSEMDKKHRKEAEEGVEEVKKSLSMKGDVDIRGNKEMFGEPSGVMDYEEDGIRPKRRRHPVTR

SEQ ID NO: 51543 - protein, 366 aa, Arabidopsis thaliana; identical to SEQ ID NO: 9373
  misc_feature: Useful for making plants with modulated nitrogen use efficiency

SEQ ID NO: 51544 - protein, 407 aa, Arabidopsis thaliana; identical to SEQ ID NO: 9421
  misc_feature: Useful for making plants with modulated biomass

SEQ ID NO: 51545 - protein, 315 aa, Arabidopsis thaliana
  misc_feature: Useful for making plants with modulated nitrogen use efficiency
MSGLMSFGELEDQFGQISDTTMEEKIPFLQMLQCIEHPFTTTEPNQFLQSLLQIQTLESKSCLTLETNIKRDPGQTDDPEKDPRTENGAVTVKEKRKRKRTRAPKNKDEVENQRMTHIAVERNRRRQMNEHLNSLRSLMPPSFLQRGDQASIVGGAIDFIKELEQLLQSLEAEKRKDGTDETPKTASCSSSSSLACTNSSISSVSTTSENGFTARFGGGDTTEVEATVIQNHVSLKVRCKRGKRQILKAIVSIEELKLAILHLTISSSFDFVIYSFNLKMEDGCKLGSADEIATAVHQIFEQINGEVMWSNLSRT

SEQ ID NO: 51546 - protein, 293 aa, Arabidopsis thaliana
  misc_feature: Useful for making plants with altered cell wall content and/or composition
MALSLIFLALLVLCPSSGHSQRSPSPGYYPSSRVPTSPFDREFRTLWGSQHQRREQDVVTLWLDKSTGSGFKSLRPYRSGYFGASIKLQPGFTAGVDTSLYLSNNQEHPGDHDEVDIEFLGTTPGKPYSLQTNVFVRGSGDRNVIGREMKFTLWFDPTQDFHHYAILWNPNQIVFFVDDVPIRTYNRKNEAIFPTRPMWVYGSIWDASDWATENGRIKADYRYQPFVAKYKNFKLAGCTADSSSSCRPPSPAPMRNRGLSRQQMAALTWAQRNFLVYNYCHDPKRDHTQTPEC

SEQ ID NO: 51547 - protein, 296 aa, Arabidopsis thaliana; identical to SEQ ID NO: 9559
  misc_feature: Useful for making plants with modulated nitrogen use efficiency

SEQ ID NO: 51548 - protein, 313 aa, Arabidopsis thaliana; identical to SEQ ID NO: 9561
  misc_feature: Useful for making plants with altered alkaloid content

SEQ ID NO: 51549 - protein, 412 aa, Arabidopsis thaliana
  misc_feature: Useful for making plants with altered cell wall content and/or composition
MAYPERSLIVDPRSGFCKSNSTFYSKRQPLSLPPNLSRDVTTFISSQPHRGKTAFIDAATGQCLTFSDLWRAVDRVADCLYHEVGIRRGDVVLILSPNSIFIPVVCLSVMSLGAVFTTANTLNTSGEISKQIADSNPTLVFTTRQLAPKLPVAISVVLTDDEVYQELTSAIRVVGILSEMVKKEPSGQRVRDRVNQDDTAMMLYSSGTTGPSKGVISSHRNLTAHVARFISDNLKRDDIFICTVPMFHTYGLLTFAMGTVALGSTVVILRRFQLHDMMDAVEKHRATALALAPPVLVAMINDADLIKAKYDLSSLKTVRCGGAPLSKEVTEGFLEKYPTVDILQGYALTESNGGGAFTNSAEESRRYGTAGTLTSDVEARIVDPNTGRFMGINQTGELWLKGPSISKGKITR

SEQ ID NO: 51550 - protein, 823 aa, Zea mays
  misc_feature: Useful for making plants with modulated biomass
  misc_feature: Useful for making plants with modulated flowering time
MPYPHPYPWQSSRRRRRRRGRDGAPRQPQARRVVERAAAGPGHATTTQQPDNVSSAKVFQTSRVETESKLRNGRKPQDLEDEHQAEEAELQPLIDQVRAMLRSMNDGDTSASAYDTAWVAMVPKVGGDGGAQPQFPATVRWIVDHQLPDGSWGDSALFSAYDRMINTLACVVALTKWSLEPARCEAGLSFLHENMWRLAEEEAESMPIGFEIAFPSLIQTARDLGVVDFPYGHPALQSIYANREVKLKRIPRDMMHRVPTSILHSLEGMPDLDWPRLLNLQSCDGSFLFSPSATAYALMQTGDKKCFEYIDRIVKKFNGGVPNVYPVDLFEHIWVVDRLERLGISRYFQREIEQCMDYVNRHWTEDGICWARKSNVKDVDDTAMAFRLLRLHGYNVSPSVFKNFEKDGEFFCFVGQSTQAVTGMYNLNRASQISFQGEDVLHRARVFSYEFLRQREEQGMIRDKWIVAKDLPGEVQYTLDFPWYASLPRVEARTYLDQYGGKDDVWIGKTLYRMPLVNNDTYLELAIRDFNHCQALHQLECNGLQTWYKDNCLDAFGVEPQDVLRSYFLAAACIFEPSRAAERLAWARTSMIANAISTHLRDISEDKKRLECFVHCLYEENDVSWLKRNPNDVILERALRRLINLLAQEALPIHEGQRFIHSLLSLAWTEWMLQKANKEENKYHKCSGIEPQYMVHDRQTYLLLVQVIEICAGRIGEAVSMINNKDNDWFIQLTCATCDSLNHRMLLSQDTMKNEARINWIEKEIELNMQELAQSLLLRCDEKTSNKKTKKTLWDVLRSLYYATHSPQHMIDRHVSRVIFEPV

SEQ ID NO: 51551 - protein, 802 aa, Arabidopsis thaliana
  misc_feature: Useful for making plants with modulated biotic stress sensitivity
MSLQYHVLNSIPSTTFLSSTKTTISSSFLTISGSPLNVARDKSRSGSIHCSKLRTQEYINSQEVQHDLPLIHEWQQLQGEDAPQISVGSNSNAFKEAVKSVKTILRNLTDGEITISAYDTAWVALIDAGDKTPAFPSAVKWIAENQLSDGSWGDAYLFSYHDRLINTLACVVALRSWNLFPHQCNKGITFFRENIGKLEDENDEHMPIGFEVAFPSLLEIARGINIDVPYDSPVLKDIYAKKELKLTRIPKEIMHKIPTTLLHSLEGMRDLDWEKLLKLQSQDGSFLFSPSSTAFAFMQTRDSNCLEYLRNAVKRFNGGVPNVFPVDLFEHIWIVDRLQRLGISRYFEEEIKECLDYVHRYWTDNGICWARCSHVQDIDDTAMAFRLLRQHGYQVSADVFKNFEKEGEFFCFVGQSNQAVTGMFNLYRASQLAFPREEILKNAKEFSYNYLLEKREREELIDKWIIMKDLPGEIGFALEIPWYASLPRVETRFYIDQYGGENDVWIGKTLYRMPYVNNNGYLELAKQDYNNCQAQHQLEWDIFQKWYEENRLSEWGVRRSELLECYYLAAATIFESERSHERMVWAKSSVLVKAISSSFGESSDSRRSFSDQFHEYIANARRSDHHFNDRNMRLDRPGSVQASRLAGVLIGTLNQMSFDLFMSHGRDVNNLLYLSWGDWMEKWKLYGDEGEGELMVKMIILMKNNDLTNFFTHTHFVRLAEIINRICLPRQYLKARRNDEKEKTIKSMEKEMGKMVELALSESDTFRDVSITFLDVAKAFYYFALCGDHLQTHISKVLFQKV

SEQ ID NO: 51552 - protein, 298 aa, Zea mays
  misc_feature: Useful for making plants with altered terpenoid content
MASSKRRFGAAGGADKKDLFHVVHKVPAGDSPYVVAKHLQLVEKQPDVAIVWFWKAINSGDRVDSALKDMAMVMKQQDRSEEAIEAIRSFRHLCSKQAQESLDNLLIDLYKKCGKVEEQIELLKQKLKSIYLGEAFNGKATKKARSHGKKFQVSIQQETSRILGNLGWAYMQQNNFEAAELVYRKAQAIEPDANRACNLGLCLIKQGRHEEARQALEDVRLRRIYGSEDAKVVARAEQLLRELNPLQCVSSPFQVGLSVHEGIMGEPDLVVMNEWTPFRSRRLPVFEEIATFRDQMAC

SEQ ID NO: 51553 - protein, 450 aa, Arabidopsis thaliana
  misc_feature: Useful for biocontainment applications
MCPCVERRAPPGVYYTPPPARTSDHVAAMPMTERRRPPYSCSSSSERRDPFHIVHKVPSGDSPYVRAKHAQLIDKDPNRAISLFWTAINAGDRVDSALKDMAVVMKQLGRSDEGIEAIKSFRYLCSFESQDSIDNLLLELYKKSGRIEEEAVLLEHKLQTLEQGMGFGGRVSRAKRVQGKHVIMTIEQEKARILGNLGWVHLQLHNYGIAEQHYRFGFVTKIPNIDYCLVMRALGLERDKNKLCNLAICLMRMSRIPEAKSLLDDVRDSPAESECGDEPFAKSYDRAVEMLAEIESKKPEADLSEKFYAGCSFVNRMKENIAPGTANKNYSDVSSSPASVRPNSAGLYTQPRRCRLFEEETRGAARKLLFGKPQPFGSEQMKILERGEEEPMKRKKLDQNMIQYLHEFVKDTADGPKSESKKSWADIAEEEEAEEEEEERLQGELKTAEM

SEQ ID NO: 51554 - protein, 284 aa, Arabidopsis thaliana
  misc_feature: Useful for making plants with altered cell wall content and/or composition
MAAFTTKQSLLLLSLLLLISLSAGSFYDNFDITWGNGRANIVESGQLLTCTLDKISGSGFQSKKEYLFGKIDMKMKLVAGNSAGTVTAYYLSSKGETWDEIDFEFLGNVTGQPYVLHTNVFTGGKGNREMQFYLWFDPTADFHTYTVLWNPLNIIFLVDGIPIRVFKNNEANGVAYPKSQPMKIYSSLWEADDWATQGGKVKTDWTNAPFSASYKSFNDVDCCSRTSLLNWVTCNANSNSWMWTTLNSNQYGQMKWVQDDYMIYNYCTDFKRFPQGLPTECNLN

SEQ ID NO: 51555 - protein, 540 aa, Panicum virgatum; identical to SEQ ID NO: 6804
  misc_feature: Useful for making plants with altered carbohydrate content

SEQ ID NO: 51556 - protein, 836 aa, Arabidopsis thaliana
  misc_feature: Useful for making plants with modulated flowering time
MSSEVKQLIVVAEGTAALGPYWQTIVSDYLEKIIRSFCGSELNGERNPVSTVELSLVIFNSHGSYCACLVQRSGWTRDVDIFLHWLSSIQFGGGGFNEVATAEGLAEALMMFSPPSGQAQPSNDLKRHCILITASNPHILPTPVYRPRLQNVERNENGDAQAESRLSDAETVASYFAKCSVSLSVVCPKQLPTIRALYNAGKPNQQSADLSIDTAKNTFYLVLISENFVEACAALSHSATNLPQTQSPVKVDRATVAPSIPVTGQPPAPVSSANGPIQNRQPVSVGPVPTATVKVEPSTVTSMAPVPSFPHIPAVARPATQAIPSIQTSSASPVSQDMVSNAENAPDIKPVVVSGMTPPLRTGPPGGANVNLLNNLSQVRQVMSSAALAGAASSVGQSAVAMHMSNMISTGMATSLPPSQTVFSTGQQGITSMAGSGALMGSAQTGQSPGPNNAFSPQTTSNVASNLGVSQPMQGMNQGSHSGAMMQGGISMNQNMMSGLGQGNVSSGTGGMMPTPGVGQQAQSGIQQLGGSNSSAPNMQLSQPSSGAMQTSQSKYVKVWEGNLSGQRQGQPVLITRLEGYRSASASDSLAANWPPTMQIVRLISQDHMNNKQYVGKADFLVFRAMSQHGFLGQLQDKKLCAVIQLPSQTLLLSVSDKACRLIGMLFPGDMVVFKPQIPNQQQQQQQQLHQQQQQQQQIQQQQQQQQHLQQQQMPQLQQQQQQHQQQQQQQHQLSQLQHHQQQQQQQQQQQQQHQLTQLQHHHQQQQQASPLNQMQQQTSPLNQMQQQTSPLNQMQQQQQPQQMVMGGQAFAQAPGRSQQGGGGGQPNMPGAGFMG

SEQ ID NO: 51557 - protein, 511 aa, Arabidopsis thaliana
  misc_feature: Useful for making plants with altered cell wall content and/or composition
MAFTSMVSTVPVLFFFFTLLLISANSSSLSHNIKVQEQDKDPFVGFNIGTDVSNLLSPTELVKFLQAQKVNHVRLYDADPELLKALAKTKVRVIISVPNNQLLAIGSSNSTAASWIGRNVVAYYPETLITAISVGDEVLTTVPSSAPLLLPAIESLYNALVASNLHTQIKVSTPHAASIMLDTFPPSQAYFNQTWHSIMVPLLQFLSKTGSPLMMNLYPYYVYMQNKGVVPLDNCLFEPLTPSKEMVDPNTLLHYTNVLDAMVDAAYVSMKNLNVSDVAVLVTESGWPSKGDSKEPYATIDNADTYNSNLIKHVFDRTGTPLHPEMTSSVYIYELFNEDLRAPPVSEASWGLFYGNSTPVYLLHVSGSGTFLANDTTNQTYCIAMDGVDAKTLQAALDWACGPGRSNCSEIQPGESCYQPNNVKGHASFAFNSYYQKEGRASGSCDFKGVAMITTTDPSHGSCIFPGSKKVGNRTQTVVNSTEVAAGEATSRSLSRGFCVTIMILVTFSIL

SEQ ID NO: 51558 - protein, 552 aa, Panicum virgatum; identical to SEQ ID NO: 6754
  misc_feature: Useful for making plants with altered carbohydrate content

SEQ ID NO: 51559 - protein, 371 aa, Arabidopsis thaliana
  misc_feature: Useful for making plants with modulated flowering time
MHITSERHPFLRGNSPGDSGLILSTDAKPRLKWTPDLHERFIEAVNQLGGADKATPKTIMKVMGIPGLTLYHLKSHLQKYRLSKNLNGQANNSFNKIGIMTMMEEKTPDADEIQSENLSIGPQPNKNSPIGEALQMQIEVQRRLHEQLELRIEAQGKYLQSVLEKAQETLGRQNLGAAGIEAAKVQLSELVSKVSAEYPNSSFLEPKELQNLCSQQMQTNYPPDCSLESCLTSSEGTQKNSKMLENNRLGLRTYIGDSTSEQKEIMEEPLFQRMELTWTEGLRGNPYLSTMVSEAEQRISYSERSPGRLSIGVGLHGHKSQHQQGNNEDHKLETRNRKGMDSTTELDLNTHVENYCTTRTKQFDLNGFSWN

SEQ ID NO: 51560 - protein, 983 aa, Arabidopsis thaliana
  misc_feature: Useful for making plants with modulated abiotic stress sensitivity
MASPHKPWRAEYAKSSRSSCKTCKSVINKENFRLGKLVQSTHFDGIMPMWNHASCILKKTKQIKSVDDVEGIESLRWEDQQKIRKYVESGAGSNTSTSTGTSTSSTANNAKLEYGIEVSQTSRAGCRKCSEKILKGEVRIFSKPEGPGNKGLMWHHAKCFLEMSSSTELESLSGWRSIPDSDQEALLPLVKKALPAAKTETAEARQTNSRAGTKRKNDSVDNEKSKLAKSSFDMSTSGALQPCSKEKEMEAQTKELWDLKDDLKKYVTSAELREMLEVNEQSTRGSELDLRDKCADGMMFGPLALCPMCSGHLSFSGGLYRCHGYISEWSKCSHSTLDPDRIKGKWKIPDETENQFLLKWNKSQKSVKPKRILRPVLSGETSQGQGSKDATDSSRSERLADLKVSIAGNTKERQPWKKRIEEAGAEFHANVKKGTSCLVVCGLTDIRDAEMRKARRMKVAIVREDYLVDCFKKQRKLPFDKYKIEDTSESLVTVKVKGRSAVHEASGLQEHCHILEDGNSIYNTTLSMSDLSTGINSYYILQIIQEDKGSDCYVFRKWGRVGNEKIGGNKVEEMSKSDAVHEFKRLFLEKTGNTWESWEQKTNFQKQPGKFLPLDIDYGVNKQVAKKEPFQTSSNLAPSLIELMKMLFDVETYRSAMMEFEINMSEMPLGKLSKHNIQKGFEALTEIQRLLTESDPQPTMKESLLVDASNRFFTMIPSIHPHIIRDEDDFKSKVKMLEALQDIEIASRIVGFDVDSTESLDDKYKKLHCDISPLPHDSEDYRLIEKYLNTTHAPTHTEWSLELEEVFALEREGEFDKYAPHREKLGNKMLLWHGSRLTNFVGILNQGLRIAPPEAPATGYMFGKGIYFADLVSKSAQYCYTCKKNPVGLMLLSEVALGEIHELTKAKYMDKPPRGKHSTKGLGKKVPQDSEFAKWRGDVTVPCGKPVSSKVKASELMYNEYIVYDTAQVKLQFLLKVRFKHKR

SEQ ID NO: 51561 - protein, 294 aa, Arabidopsis thaliana
  misc_feature: Useful for making plants with modulated flowering time
MKRLSSSDSMCGLISTSTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRRDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 51562 - protein, 670 aa, Arabidopsis thaliana
  misc_feature: Useful for making plants with modulated herbicide sensitivity
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVENLPVKVLLLNNQHLGMVMQWEDRFYKANRAHTFLGDPAQEDEIFPNMLLFAAACGIPAARVTKKADLREAIQTMLDTPGPYLLDVICPHQEHVLPMIPSGGTFNDVITEGDGRIKY

SEQ ID NO: 51563 - protein, 332 aa, Arabidopsis thaliana
  misc_feature: Useful for making plants with altered cell wall content and/or composition
MGFITRFLVFMSLFTSLVSGFALQKLPLIQFDEGYTQLFGDQNLIVHRDGKSVRLTLDERTGSGFVSNDIYLHGFFSSSIKLPADYSAGVVIAFYLSNGDLYEKNHDEIDFEFLGNIRGREWRIQTNIYGNGSTHLGREERYNLWFDPTEDFHQYSILWSLSHIIFYVDNVPIREVKRTASMGGDFPAKPMSLYSTIWDGSKWATDGGKYGVNYKYAPYVSQFTDLILHGCAVDPTEKFPSCKDEAVQNLRLASEITESQRNKMEIFRQKHMTYSYCYDHMRYKVVLSECVVNPAEAKRLRVYDPVTFGGIPHGHRRGKHRSRSRLARTESI

SEQ ID NO: 51564 - protein, 313 aa, Arabidopsis thaliana; identical to SEQ ID NO: 9249
  misc_feature: Useful for making plants with modulated nitrogen use efficiency

SEQ ID NO: 51565 - protein, 570 aa, Zea mays; identical to SEQ ID NO: 9443
  misc_feature: Useful for making plants with modulated nitrogen use efficiency

SEQ ID NO: 51566 - protein, 1660 aa, Arabidopsis thaliana
  misc_feature: Useful for making plants with altered low light response
  misc_feature: Useful for making plants with modulated biomass
  misc_feature: Useful for making plants with modulated flowering time
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQFICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYPLGVTPTDSQINDIVEWLVANHSDSTGLSTDSLGDAGYPRAAALGDAVCGMAVACITKRDFLFWFRSHTEKEIKWGGAKHHPEDKDDGQRMNPRSSFQTFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSCALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSIDGKIIGAFCFLQIPSPELQQALEVQRRQESEYFSRRKELAYIFQVIKNPLSGLRFTNSLLEDMDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSSMVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAIPSPELQQALEVQRRQESEYFSRRKELAYIFQVIKNPLSGLRFTNSLLEDMDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 51567 - protein, 541 aa, Arabidopsis thaliana; identical to SEQ ID NO: 9471
  misc_feature: Useful for making plants with modulated light quality sensitivity
  misc_feature: Useful for making plants with modulated low light sensitivity

SEQ ID NO: 51568 - protein, 329 aa, Arabidopsis thaliana
  misc_feature: Useful for making plants with altered cell wall content and/or composition
MALQFFSCKPKYTFLSSLLLLLLLSSSVAELSFNFYAGSCPGAELIVRNTVRSASSSDPSVLGKLLRLIFHDCFVQGCDGSVLIRGNGTERSDPGNASLGGFAVIESVKNILEIFCPGTVSCADILVLAARDAVEALGGPVVPIPTGRRDGRVSMAANVRPNIIDTDFTVDKMINIFSSKGLSVHDLVVLSGAHTIGAAHCNTFNSRFKLDPKGNLELIDASLDNSYAQTLVNKCSSSLDPTTTVVDNDPETSSTFDNQYYKNLLAHKGLFQTDSALMEDDRTRKIVEILANDQESFFDRWTESFLKMSLMGVRVGEEGEIRRSCSAVN

SEQ ID NO: 51569 - protein, 279 aa, Panicum virgatum; identical to SEQ ID NO: 3918
  misc_feature: Useful for making plants with altered carbohydrate content

SEQ ID NO: 51570 - protein, 276 aa, Arabidopsis thaliana
  misc_feature: Useful for making plants with modulated nitrogen use efficiency
MTASGGGSTAATGRMPTWKERENNKKRERRRRAIAAKIFTGLRSQGNYKLPKHCDNNEVLKALCLEAGWIVHEDGTTYRKGSRPTETTVPCSSIQLSPQSSAFQSPIPSYQASPSSSSYPSPTRFDPNQSSTYLIPYLQNLASSGNLAPLRISNSAPVTPPISSPRRSNPRLPRWQSSNFPVSAPSSPTRRLHHYTSIPECDESDVSTVDSCRWGNFQSVNVSQTCPPSPTFNLVGKSVSSVGVDVSVKPWEGEKIHDVGIDDLELTLGHNTKGRG

SEQ ID NO: 51571 - protein, 339 aa, Panicum virgatum; identical to SEQ ID NO: 1090
  misc_feature: Useful for making plants with altered carbohydrate content

SEQ ID NO: 51572 - protein, 327 aa, Arabidopsis thaliana
  misc_feature: Useful for making plants with altered cell wall content and/or composition
MANAKPFCLLGFFCLLLQLFSIFHIGNGELEMNYYKESCPKAEEIIRQQVETLYYKHGNTAVSWLRNLFHDCVVKSCDASLLLETARGVESEQKSKRSFGMRNFKYVKIIKDALEKECPSTVSCADIVALSARDGIVMLKGPKIEMIKTGRRDSRGSYLGDVETLIPNHNDSLSSVISTFNSIGIDVEATVALLGAHSVGRVHCVNLVHRLYPTIDPTLDPSYALYLKKRCPSPTPDPNAVLYSRNDRETPMVVDNMYYKNIMAHKGLLVIDDELATDPRTAPFVAKMAADNNYFHEQFSRGVRLLSETNPLTGDQGEIRKDCRYVN

SEQ ID NO: 51573 - protein, 247 aa, Arabidopsis thaliana
  misc_feature: Useful for making plants with altered cell wall content and/or composition
MASNSSNGTTTTKPPPMPSPLRNSKFFQSNMRILVTGGAGFIGSHLVDKLMQNEKNEVIVADNYFTGSKDNLKKWIGHPRFELIRHDVTEPLFVEVDQIYHLACPASPIFYKYNPVKTIKTNVIGTLNMLGLAKRVGARILLTSTSEVYGDPLVHPQTESYWGNVNPIGVRSCYDEGKRVAETLMFDYHRQHGIEIRIARIFNTYGPRMNIDDGRVVSNFIAQALRGEALTVQKPGTQTRSFCYVSD

SEQ ID NO: 51574 - protein, 350 aa, Panicum virgatum; identical to SEQ ID NO: 6188
  misc_feature: Useful for making plants with altered carbohydrate content

SEQ ID NO: 51575 - protein, 134 aa, Arabidopsis thaliana; identical to SEQ ID NO: 9299
  misc_feature: Useful for making plants with modulated heat sensitivity

SEQ ID NO: 51576 - protein, 270 aa, Arabidopsis thaliana; identical to SEQ ID NO: 9207
  misc_feature: Useful for making plants with altered lignin content

SEQ ID NO: 51577 - protein, 317 aa, Zea mays
  misc_feature: Useful for making plants with altered alkaloid content
MEFIDPWDSQSRARVVHSGANSTSFSSSTAKAPLSLRHAASCAAAAVALLAAAFYLLPTYQILSSLLIWIASSLLLAPFAPLSATGGDISVGRGRVVPAPEPAPEPTPEPTPAPRRGRRQNPVPTPTKPSDPGTPPVQSAASLHPLQKATTAGGAVVDGGEREEDAGEWTDQELELLRRQMVKHPAGEPQRWEKIAAVFGGRRTPENVIRAAKSGAPAAGGSSFEQFLRKRKPLDPRAEVADTADDAGGAESADAAWSAGDDRALLNALKEFPKDTAMRWEKVAASVPGKTKAACMKRITELKRDFRSTKTASEAAP

SEQ ID NO: 51578 - protein, 918 aa, Arabidopsis thaliana
  misc_feature: Useful for making plants with altered tocopherol content
MGHQNAAVSENQNHDDGAASSPGFKLVGFSKFVRKNPKSDKFKVKRFHHIEFWCGDATNVARRFSWGLGMRFSAKSDLSTGNMVHASYLLTSGDLRFLFTAPYSPSLSAGEIKPTTTASIPSFDHGSCRSFFSSHGLGVRAVAIEVEDAESAFSISVANGAIPSSPPIVLNEAVTIAEVKLYGDVVLRYVSYKAEDTEKSEFLPGFERVEDASSFPLDYGIRRLDHAVGNVPELGPALTYVAGFTGFHQFAEFTADDVGTAESGLNSAVLASNDEMVLLPINEPVHGTKRKSQIQTYLEHNEGAGLQHLALMSEDIFRTLREMRKRSSIGGFDFMPSPPPTYYQNLKKRVGDVLSDDQIKECEELGILVDRDDQGTLLQIFTKPLGDRPTIFIEIIQRVGCMMKDEEGKAYQSGGCGGFGKGNFSELFKSIEEYEKTLEAKQLVGMCLSLASTAQRNTQFRSRVLVLAELVKSMGHQNAAVSENQNHDDGAASSPGFKLVGFSKFVRKNPKSDKFKVKRFHHIEFWCGDATNVARRFSWGLGMRFSAKSDLSTGNMVHASYLLTSGDLRFLFTAPYSPSLSAGEIKPTTTASIPSFDHGSCRSFFSSHGLGVRAVAIEVEDAESAFSISVANGAIPSSPPIVLNEAVTIAEVKLYGDVVLRYVSYKAEDTEKSEFLPGFERVEDASSFPLDYGIRRLDHAVGNVPELGPALTYVAGFTGFHQFAEFTADDVGTAESGLNSAVLASNDEMVLLPINEPVHGTKRKSQIQTYLEHNEGAGLQHLALMSEDIFRTLREMRKRSSIGGFDFMPSPPPTYYQNLKKRVGDVLSDDQIKECEELGILVDRDDQGTLLQIFTKPLGDRPTIFIEIIQRVGCMMKDEEGKAYQSGGCGGFGKGNFSELFKSIEEYEKTLEAKQLVG

SEQ ID NO: 51579 - protein, 135 aa, Arabidopsis thaliana; identical to SEQ ID NO: 9325
  misc_feature: Useful for biocontainment applications

SEQ ID NO: 51580 - protein, 133 aa, Arabidopsis thaliana
  misc_feature: Useful for making plants with modulated heat sensitivity
MEKMGIDQLKALKEQADLEVNLLQDSLNNIRTATVRLDAAAAALNDLSLRPQGKKMLVPLTASLYVPGTLDEADKVLVDIGTGYFIEKTMDDGKDYCQRKINLLKSNFDQLFEVAAKKKSVADEAGMVLQAKV

SEQ ID NO: 51581 - protein, 390 aa, Arabidopsis thaliana
  misc_feature: Useful for making plants with altered cell wall content and/or composition
SSLLRCRKWAKSDWLVASIGCVLIVFFLSFFFDPTSDSVPSVDRSRPIISPSDLVKLKLSSVAKERGAFCLDGSLPGYHFHEGSGSGSQSWLVHLEGGGWCNTVASCSARALTKLGSSNYFEQEVAFQGVLSSDPSQNPEFFNWNKVAIRYCDGASFSGRPEAEFKNGTRLFFRGQLIWEAIIDELLSMGMSDAKQAILTGCSAGGLASLIHCDYFRDHLPKDAAVKCVSDGGYFLNVPDVLGNPTMRSFYHDVVNLQGVEKSLDQKCVAKTEPSKCMFPQEFLKNIRTPVFLVNPAYDFWQIQHVLVPTSADPDKSWAKCRLNIKECDAEQIKVLHGFRSSMMTAIGEFHQNKDGGMFIDSCYAHCQTVMSVTWHSLTSPRIENKVKDI

SEQ ID NO: 51582 - protein, 369 aa, Arabidopsis thaliana
  misc_feature: Useful for making plants with modulated nitrogen use efficiency
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 51583 - protein, 328 aa, Panicum virgatum; identical to SEQ ID NO: 2126
  misc_feature: Useful for making plants with altered carbohydrate content

SEQ ID NO: 51584 - protein, 130 aa, Arabidopsis thaliana; identical to SEQ ID NO: 9193
  misc_feature: Useful for making plants with modulated nitrogen use efficiency

SEQ ID NO: 51585 - protein, 328 aa, Panicum virgatum; identical to SEQ ID NO: 324
  misc_feature: Useful for making plants with altered carbohydrate content

SEQ ID NO: 51586 - protein, 328 aa, Arabidopsis thaliana
  misc_feature: Useful for making plants with altered cell wall content and/or composition
MADNTGSEMKSGSFMLEKSAKIFVAGHRGLVGSAIVRKLQDQGFTNLVLRTHSELDLTSQSDVESFFATEKPVYVILAAAKVGGIHANNTYPADFIGVNLQIQTNVIHSAYTHGVKKLLFLGSSCIYPKFAPQPIPESALLTGPLEPTNEWYAIAKIAGIKMCQAYRLQHQWDAISGMPTNLYGQNDNFHPENSHVLPALMRRFHEAKANNADEVVVWGSGSPLREFLHVDDLADACVFLMDQYSGFEHVNVGSGVEVTIKELAELVKEVVGFKGKLVWDTTKPDGTPRKLMDSSKLASLGWTPKISLKDGLSQTYEWYLENVVQKKQ

SEQ ID NO: 51587 - protein, 380 aa, Arabidopsis thaliana
  misc_feature: Useful for making plants with modulated nitrogen use efficiency
MSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILSPIPQYPLYSASIALHGGSLVPYYLDEATGWGLEISDLKKQLEEARSKGISVRALVVINPGNPTGQVLAEENQRDIVNFCKQEGLVLLADEVYQENVYVPDKKFHSFKKVARSLGYGEKDISLVSFQSVSKGYYGECGKRGGYMEVTGFTSDVREQIYKMASVNLCSNISGQILASLVMSPPKKEMEFSHPWLNVQRLWKTLSTV

SEQ ID NO: 51588 - protein, 711 aa, Arabidopsis thaliana
  misc_feature: Useful for making plants with modulated biomass
  misc_feature: Useful for making plants with modulated flowering time
MTSYGDRLKSTSINGVKLYNVSSAPNVPTWLNPKKQRALRKNPHYMQRVELIQELKFETATTRIKATPDGEYLIASGIYPPQVKVYELNQLALKFERHLDSEIVDFEILDDDFSKLAFLCADRSINLHAKYGKHHTLRIPRMGRDMTYDSWSCDLLCAASSPDLYRINLEQGRFLSPLSTQSPALNVVSRSNLHGLVACGGEDGAVEFFDMRMKSSAARINAVTHGGDAAAEVTAIEFDDSEGLQVAVGSSAGKVFIYDLRTSTPIRVKDHMYESPILNIKWQRTLNTQQPKLITTNKHIVRIWDPNTGEGMTSIEPTQGGINDICVFRGSGLMLLALDSSLIPSYFIPELGPAPKWCSPLENLTEELEESAQTTIYDNYKFLAMEDLEKLQLTHLIGTDLLKASMHGYFINYHLYKKALAVIEPFAFDDYLERRKQEKLEEQRTQRITKKRRLPKVNRDLAARLHGDESEEENKTAEDGEATKKVLKKKKPILTDEHFVDGRFGSMFQNPDFQIDKDSYEYGVLHPVASSKKQPSLLDEHFEAVSDDDENSDSDASQPSDDEADDGDATRPSKKARTPKLYEVKDERHAAAYHNRTSLAKEDSLPMGERVKAIENRRGNFGGSKDIKFGPGGSREFSFKARGSSKYKEDRDDEYEDGQRNKRRGVQSLGLKSTNIRGGFRGRGGGGFRGRGGGGSRGKGGRGGGRGRGRQ

SEQ ID NO: 51589 - protein, 446 aa, Arabidopsis thaliana; identical to SEQ ID NO: 9709
  misc_feature: Useful for making plants with modulated biomass

SEQ ID NO: 51590 - protein, 613 aa, Zea mays
  misc_feature: Useful for making plants with modulated yield
MLTATPLPHQLLATFLLVLASATQPAVPASTDRAALLAFRASLSPPSRAALSSWSGPLSPSWLGVSLHPATAPAPSVTTPSVAELSLRGLNLTGVIPAAPLALLRRLRTLDLSANALSGELPCSLPRSLLALDLSRNALSGAVPTCLPSSLPALRTLNLSANFLRLPLSPRLSFPARLAALDLSRNAISGAVPPRIVADPDNSALLLLDLSHNRFSGEIPAGIAAVRSLQGLFLADNQLSGDIPPGIGNLTYLQVLDLSNNRLSGSVPAGLAGCFQLLYLQLGGNQLSGALRPELDALASLKVLDLSNNKISGEIPLPLAGCRSLEVVDLSGNEISGELSSAVAKWLSLKFLSLAGNQLSGHLPDWMFSFPLLQWLDLSSNKFVGFIPDGGFNVSEVLNGGGGQGTPSESVLPPQLFVSASVDTVSWQLDLGYDVQATTGIDLSGNELCGEIPEGLVDMKGLEYLNLSCNYLAGQIPAGLGGMGRLHTLDFSHNGLSGEVPPGIAAMTVLEVLNLSYNSLSGPLPTTKFPGALAGNPGICSGKGCSENARTPEGKMEGSNHRGWLGGWHGENGWVSLGAFCISTMTSFYVSLATLLCSSNARNFVFRPVRVEY

SEQ ID NO: 51591 - protein, 310 aa, Arabidopsis thaliana; identical to SEQ ID NO: 9489
  misc_feature: Useful for making plants with altered alkaloid content

SEQ ID NO: 51592 - protein, 471 aa, Arabidopsis thaliana
  misc_feature: Useful for making plants with altered cell wall content and/or composition
MTILVVDRYYMLMNLLFALTCLLLNLTHCFSPKKFNISAATTSDSDWSIAGSTWYGNPTGYGSDGGACGYGNAVAQPPFSKMVSAGGPSLFKSGKGCGACYQVKCTSKSACSKNPVTVVITDECPGCVKESVHFDLSGTAFGAMAISGQDSQLRNVGELQILYKKVECNYIGKTVTFQVDKGSNANSFAVLVAYVNGDGEIGRIELKQALDSDKWLSMSQSWGAVWKLDVSSPLRAPLSLRVTSLESGKTVVASNVIPANWQPGGACGFAVANPPLYGMVSAGGPSVFNNGIGCGTCFQILCNGHPACSRRPITVTITDECPGGPCASEPAHFDLSGKAMGALARPGQGDRLRSAGVLRVYYRRVECLYRRTNIAFRMDPGANPYYISFVVEYENGDGDLAYIEIQPADGEFIPMQEMRSAVWKISSGSPLTGPFNIRLTSAESHKVVLAYNVIPANWKPNETYRSVVNFK

SEQ ID NO: 51593 - protein, 236 aa, Oryza sativa; identical to SEQ ID NO: 9761
  misc_feature: Useful for biocontainment applications

SEQ ID NO: 51594 - protein, 164 aa, Arabidopsis thaliana
  misc_feature: Useful for making plants with modulated cold sensitivity
MASSFSSQAFFLLTLSMVLIPFSLAQAPMMAPSGSMSMPPMSSGGGSSVPPPVMSPMPMMTPPPMPMTPSPMPMTPPPMPMAPPPMPMASPPMMPMTPSTSPSPLTVPDMPSPPMPSGMESSPSPGPMPPAMAASPDSGAFNVRNNVVTLSCVVGVVAAHFLLV

SEQ ID NO: 51595 - protein, 450 aa, Panicum virgatum; identical to SEQ ID NO: 3080
  misc_feature: Useful for making plants with altered carbohydrate content

SEQ ID NO: 51596 - protein, 311 aa, Zea mays; identical to SEQ ID NO: 9200
  misc_feature: Useful for making plants with modulated oxidative stress sensitivity
  misc_feature: Useful for making plants with modulated salt sensitivity

SEQ ID NO: 51597 - protein, 219 aa, Arabidopsis thaliana
  misc_feature: Useful for making plants with altered terpenoid content
MSERDRRERERDRDREPDRDRRRGRDDRDRDRDRDRERDRERDRDRGLRNKKSRSRTPDHHARARHVRSPERYRSRSRSIDRDRDRDRQRHHRRRSPSPDAPSRKRPRQGSVDDEKERNRKRVVTDSVDENAPTITKKKDKQPSDAADNGGGEDEEGMDVNEIEMMKMLGIPTGFDSTKGKPVAGADVSGIRAVTKRQPRQYMNRRGGFNRPLPAERNR

SEQ ID NO: 51598 - protein, 471 aa, Arabidopsis thaliana
  misc_feature: Useful for making plants with altered cell wall content and/or composition
MKRSFLLLYVLLVQAFYGAWCSVGESLHCEYSNLASLHRPHSVSITEFGAVGDGVTLNTKAFQNALFYLNSFSDKGGAKLFVPAGQWLTGSFDLISHLTLWLDKGATILGSTSSENWPVVDPLPSYGRGRELPGRRHRSLIYGQNLTDVVITGENGTIDGQGTVWWDWFRNGELNYTRPHLVELMNSTGLIISNLTFLNSPFWNIHPVYCRDVVVKNLTILAPLESPNTDGVDPDSSTNVCIEDCYIVTGDDLVSIKSGWDEYGISYARPSSKIKINRLTGQTTSSSGIAIGSEMSGGVSEIYIKDLHLFNSNTGIRIKTSAGRGGYVRNVHILNVKLDNVKKAIRFTGKYGEHPDEKYDPKALPAIEKITFENVNGDGIGVAGLLEGIEGDVFKNICFLNVTLRVKKNSKKSPWECSNVRGYSQWVSPEITCDSLKESIFPEHGSDCFGLSENNMEISSGLSRSPWLLSW

SEQ ID NO: 51599 - protein, 322 aa, Arabidopsis thaliana; identical to SEQ ID NO: 9619
  misc_feature: Useful for making plants with altered lignin content

SEQ ID NO: 51600 - protein, 254 aa, Arabidopsis thaliana
  misc_feature: Useful for making plants with modulated nitrogen use efficiency
MIMASSAAASISMITLRNLSRNHQSHQSTFLGFSRSFHNQRISSNSPGLSTRARSTTSSTGGFFRTICSSSSNDYSRPTKIQELNVYEFNEGDRNSPAVLKLGKKPDQLCLGDLVPFTNKLYTGDLTKRIGITAGLCVLIQHVPEKKGDRFEASYSFYFGDYGHISVQGPYLTYEDTFLAITGGSGVFEGAYGQVKLRQLVYPTKLFYTFYLKGVAADLPVELTGKHVEPSKEVKPAAEAQATQPGATIANFTN

SEQ ID NO: 51601 - protein, 114 aa, Arabidopsis thaliana; identical to SEQ ID NO: 9245
  misc_feature: Useful for making plants with altered lignin content

SEQ ID NO: 51602 - protein, 759 aa, Arabidopsis thaliana
  misc_feature: Useful for making plants with altered cell wall content and/or composition
MRGLLRASSLLLCGVILIQLLAAQIHAQSKKPKSPWPTLTGDPPLVIARGGFSGLFPDSSYDAYNFAILTSVPDAVLWCDVQLTKDALGICFPDLTMRNSSSIEAVYPTRQKSYPVNGVPTSGWFTIDFSLKDLKDVNLIRGILSRSEKFDGNSNPIMTVQSVSTQMKPSFFWLNVQHDAFYAQHNLSMSSFLVAASKTVLIDFISSPEVNFFKKIAGRFGRNGPSLVFRFLGQDEFEPTTNRTYGSILSNLTFVKTFASGILVPKSYILPLDDQQYLLPHTSLVQDAHKAGLEVFVSGFANDIDIAHDYSFDPVSEYLSFVDNGNFSVDGVLSDFPITASASLDCFSHVGRNATKQVDFLVITKDGASGDYPGCTDLAYKKAIKDGADVIDCSVQLSSDGTPFCLSSIDLGNSTTVSLTAFRNRSTTVPELGSLGAIYTFSLTWAEIQTLTPAISNPYRVTSLFRNPKQKNAGKLFSLSDFLSLAKNSTSLSGVLISVENAAYLREEQGLDVVKAVLDTLTQTGYSNSTATKVMIQSTNSSVLVDFKKQSQYETVYKVEENIRDILDSAIEDIKKFADAVVIQKLSVFPVAQSFITTQTNVVEKLQKSQLPVYVELFQNEFLSQPYDFFADATVEINSYITGAGINGTITEFPFTAARYKRNLCLGRKETIPYMAPAQPGALLTLVSPTAFPPAEAPNPVFTDADVTEPPLPPVTAKAPTSSPGTPSTNAQAPSGQTRITLSLLLSVFAMVLASLLLL

SEQ ID NO: 51603 - protein, 217 aa, Arabidopsis thaliana; identical to SEQ ID NO: 9741
  misc_feature: Useful for biocontainment applications
  misc_feature: Useful for making plants with modulated flowering time

SEQ ID NO: 51604 - protein, 148 aa, Arabidopsis thaliana; identical to SEQ ID NO: 9736
  misc_feature: Useful for making plants with modulated biomass

SEQ ID NO: 51605 - protein, 120 aa, Arabidopsis thaliana; identical to SEQ ID NO: 9667
  misc_feature: Useful for making plants with modulated nitrogen use efficiency

SEQ ID NO: 51606 - protein, 315 aa, Arabidopsis thaliana; identical to SEQ ID NO: 9409
  misc_feature: Useful for making plants with altered lignin content
  misc_feature: Useful for making plants with modulated nitrogen use efficiency

SEQ ID NO: 51607 - protein, 417 aa, Glycine max; identical to SEQ ID NO: 9664
  misc_feature: Useful for making plants with altered alkaloid content
  misc_feature: Useful for making plants with altered terpenoid content

SEQ ID NO: 51608 - protein, 135 aa, Arabidopsis thaliana
  misc_feature: Useful for making plants with modulated nitrogen use efficiency
MASLGHIARESSDITRLAQFYKEVFGFEEIESPDFGDLQVVWLNLPGAFAMHIIQRNPSTNLPEGPYSATSAVKDPSHLPMGHHICFSVPNFDSFLHSLKEKGIETFQKSLPDGKVKQVFFFDPDGNGLEVASRS

SEQ ID NO: 51609 - protein, 153 aa, Arabidopsis thaliana
  misc_feature: Useful for making plants with altered alkaloid content
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 51610 - protein, 79 aa, Arabidopsis thaliana
  misc_feature: Useful for making plants with altered lignin content
  misc_feature: Useful for making plants with modulated flowering time
  misc_feature (79)..(79): Xaa is any aa, unknown, or other
MVKQELKIQVTTSSSSLSHSSSSSSSSTSALRHQSCKNKIKKYKGVRMRSWGSWVTEIRAPNQKTRIWLGSYSTAEAAX

SEQ ID NO: 51611 - protein, 379 aa, Arabidopsis thaliana
  misc_feature: Useful for making plants with altered cell wall content and/or composition
MQSRMASTTIILFLSFSIIPLLTIVRADNHSVYCPPPPPCICICNPGPPPPQPDPQPPTPPTFQPAPPANDQPPPPPQSTSPPPVATTPPALPPKPLPPPLSPPQTTPPPPPAITPPPPPAITPPLSPPPPAITPPPPLATTPPALPPKPLPPPLSPPQTTPPPPPAITPPLSPPLVGICSKNDTELKICAGILAISDGLLTTGRAEPCCSIIRNVSDLDAVTCFCKSVGAPRFSLSPNFGIFFKVCGRRIPQGFSCPGPSPTISPPPLPPQTLKPPPPQTTPPPPPAITPPLSPPLVGICSKNDTELKICAGILAISDGLLTTGRAEPCCSIVRNVSDLDAVTCFCKSVGARRFSLSPNFGIFFKVCGRRIPQGFSCP

SEQ ID NO: 51612 - protein, 806 aa, Arabidopsis thaliana
  misc_feature: Useful for making plants with modulated heat sensitivity
MSSSTLQASLFLRPPLHTSSFKLYPCLFSSSSLSFCPQSLSSFYRLSSVLHNSRFRPLPCSLRQDNVASDSDFIPKDSAFEVTDSAESNRLVSDTEVSELETNDRFVGGEETKSGGEEAEVSNGVTEGKEEDQKKSKFRIVVLMMALWAAIKRAIEKVMEWEWLSWWPFSRQEKRLEKLIAEADANPKDAALQGALLAELNKHIPEAVVQRFEQREHTVDSRGVAEYIRALVITNAISEYLPDEQTGKPSSLPALLQELKHRASGNMDESFVNPGISEKQPLHVTMVNPKVSNKSRFAQELVSTILFTVAVGLVWIMGAAALQKYIGSLGGIGTSGVGSSSSYSPKELNKEITPEKNVKTFKDVKGCDDAKQELEEVVEYLKNPSKFTRLGGKLPKGILLTGAPGTGKTLLAKAIAGEAGVPFFYRAGSEFEEMFVGVGARRVRSLFQAAKKKAPCIIFIDEIDAVGSTRKQWEGHTKKTLHQLLVEMDGFEQNEGIIVMAATNLPDILDPALTRPGRFDRHIVVPSPDVRGREEILELYLQGKPMSEDVDVKAIARGTPGFNGADLANLVNIAAIKAAVEGAEKLSSEQLEFAKDRIVMGTERKTMFVSEDSKKLTAYHESGHAIVALNTKGAHPIHKATIMPRGSALGMVTQLPSNDETSVSKRQLLARLDVCMGGRVAEELIFGLDHITTGASSDLSQATELAQYMVSSCGMSEAIGPVHIKERPSSDMQSRIDAEVVKLLREAYERVKSLLKRHEKQLHTLANALLEYETLTAEDIKRILLPKQEGEKFEEQQQEEGDLVLA

SEQ ID NO: 51613 - protein, 325 aa, Arabidopsis thaliana
  misc_feature: Useful for making plants with altered cell wall content and/or composition
MLTRFKKQNNKMVRANIVSMVLLMHAIVGFPFHARGLSMTYYMMSCPFAEQIVKNSVNNALQADPTLAAGLIRMLFHDCFIEGCDASILLDSTKDNTAEKDSPANLSLRGYEIIDDAKEKIENRCPGVVSCADIVAMAARDAVFWAGGPYYDIPKGRFDGKRSKIEDTRNLPSPFLNASQLIQTFGQRGFTPQDVVALSGAHTLGVARCSSFKARLTVPDSSLDSTFANTLSKTCSAGDNAEQPFDATRNDFDNAYFNALQMKSGVLFSDQTLFNTPRTRNLVNGYALNQAKFFFDFQQAMRKMSNLDVKLGSQGEVRQNCRSIN

SEQ ID NO: 51614 - protein, 287 aa, Zea mays; identical to SEQ ID NO: 9447
  misc_feature: Useful for making plants with altered terpenoid content

SEQ ID NO: 51615 - protein, 259 aa, Arabidopsis thaliana; identical to SEQ ID NO: 9211
  misc_feature: Useful for making plants with altered alkaloid content

SEQ ID NO: 51616 - protein, 282 aa, Arabidopsis thaliana
  misc_feature: Useful for making plants with altered cell wall content and/or composition
MKLSCGTSFAFLIMFLFAAQSMHVYAGSFHKDVQIHWGDGRGKVRDRDGKLLSLSLDKSSGSGFQSNQEFLYGKAEVQMKLVPGNSAGTVTTFYLKSPGTTWDEIDFEFLGNLSGHPYTLHTNVYTKGSGDKEQQFHLWFDPTVNFHTYCITWNPQRIIFTVDGIPIREFKNSESIGVPFPTKQPMRLYASLWEAEHWATRGGLEKTDWSKAPFTAFYRNYNVEGCVWANGKSSCPANSSWFTQQLDSNGQTRMKGVQSKYMVYNYCNDKRRFPRGVPVECS

SEQ ID NO: 51617 - protein, 379 aa, Arabidopsis thaliana; identical to SEQ ID NO: 9224
  misc_feature: Useful for making plants with modulated biomass

SEQ ID NO: 51618 - protein, 120 aa, Arabidopsis thaliana
  misc_feature: Useful for biocontainment applications
MEISQARSSFVCLLLLLSIFFIPCVFSKSPRPISDVEIRQKKSECYGDIESGLWGWQCKSSAIAKENCALRCLSPVCYQLIYESDPLEEGEKDLIRSQEYKYCMYKSSLGESLEGVRGIF

SEQ ID NO: 51619 - protein, 247 aa, Arabidopsis thaliana
  misc_feature: Useful for making plants with altered cell wall content and/or composition
MSSSLFSYVVLLIFLFTIPYIQSQPTAPAPTTEKSPINLTAILEAGHQFTTLIQLLNTTQVGFQVSVQLNSSDQGMTIFAPTDNAFNKLKPGTLNSLTYQQQIQLMLYHIIPKYYSLSDLLLASNPVRTQATGQDGGVFGLNFTGQAQSNQVNVSTGVVETRINNALRQQFPLAVYVVDSVLLPEELFGTKTTPTGAPAPKSSTSSSDADSPAADDEHKSAGSSVKRTSLGIVVSFALFCCSVIYIA

SEQ ID NO: 51620 - protein, 282 aa, Arabidopsis thaliana
  misc_feature: Useful for making plants with altered cell wall content and/or composition
MVSFCGRRFAFLIIFLFAAQYERVYAGSFHKDVQIHWGDGRGKILDNVGNLLSLSLDKFSGSGFQSHQEFLYGKVEVQMKLVPGNSAGTVTTFYLKSPGTTWDEIDFEFLGNISGHPYTLHTNVYTKGTGDKEQQFHLWFDPTVDFHTYCIIWNPQRVIFTIDGIPIREFKNSEALGVPFPKHQPMRLYASLWEAEHWATRGGLEKTDWSKAPFTAFYRNYNVDACVWSNGKSSCSANSSWFTQVLDFKGKNRVKWAQRKYMVYNYCTDKKRFPQGAPPECS

SEQ ID NO: 51621 - protein, 517 aa, Arabidopsis thaliana
  misc_feature: Useful for making plants with altered cell wall content and/or composition
MAIKSIFIIIIISIITSISELYALDPSFLRLSTSLQRSSFPQDFRFGAASSAYQSEGAANVDGREPSIWDTFTKQYPEKISDGSNGDVADEFYYRFKEDVAHMKEIGLDSFRFSISWSRILPRGTVAGGVNQAGINFYNHLINELISNGIRPLVTLFHWDTPQALEDEYGGFLNPQIVKDFVEYVDICFKEFGDRVKEWITINEPNMFAVLGYNVGNIAPGRCSSYVQNCTVGNSATEPYLVAHYLILSHAATVQLYREKYQSFHGGTIGMTIQTYWMIPKYNTPACREAAKRALDFFFGWFADPITYGDYPKTMRELVGNRLPKFTKKQSKMVRGSFDFFGLNYYTSRYVEDVMFYANTNLSYTTDSRVNQTTEKNGVPVGEPTSADWLFICPEGFQDVLLYIKSKFQNPVILVTENGMPSENDKSLSVNIALNDEAKIKYHQLHLTALLEAVSQGADVRGYYIWSLMDDFEWEFGYKYRYGLVYVDFQDGLKRHLKSSALWYHHFLSNSSSYQMD

SEQ ID NO: 51622 - protein, 449 aa, Arabidopsis thaliana
  misc_feature: Useful for making plants with altered cell wall content and/or composition
MPVSVALVLLLTLSSVILINGRSYGVGNICDRGRRPSERPHSVKITDFGAVGDGKTLNTLAFQNAVFYLKSFADKGGAQLYVPPGRWLTGSFNLTSHLTLFLEKDAVILASQDPSHWQVTDALPSYGRGIDLPGKRYMSLINGDMLHDVVVTGDNGTIDGQGLVWWDRFNSHSLEYSRPHLVEFVSAENVIVSNLTFLNAPAYTIHSVYCRNLYIHRVTANTCPESPYTIGIVPDSSENVCIQESSINMGYDAISLKSGCDEYGLSYARPTANVQIRNVYLRAASGSSISFGSEMSGGISDVEVSDAHIHNSLSGIAFRTTNGRGGYIKEIDISNIHMVNVGTAFLANGSFGTHPDSGFDENAYPLVSHIRLHDIVGENISTAGYFFGTKESPFTSILLSNISLSIKNSASPADSWQCSYVDGSSEFVVPEPCLELKSFDSYYGRAEAL

SEQ ID NO: 51623 - protein, 261 aa, Panicum virgatum; identical to SEQ ID NO: 8712
  misc_feature: Useful for making plants with altered carbohydrate content

SEQ ID NO: 51624 - protein, 161 aa, Arabidopsis thaliana
  misc_feature: Useful for making plants with modulated biomass
  misc_feature (102)..(102): Xaa is any aa, unknown, or other
  misc_feature (143)..(143): Xaa is any aa, unknown, or other
MSRALSVVCVLLAISFVCARARQVPGESDEGKTTGHDDTTTMPMHAKAADQLPPKSVGDKKCIGGVAGVGGFAGVGGVAGVGGLGMPLIGGLGGIGKYGGIXGAAGIGGFHSIGGVGVLGGVGGGVGRSRRCWRGCWWSRWRXRSRWSWFRRCRWCWRWYW

SEQ ID NO: 51625 - protein, 244 aa, Panicum virgatum; identical to SEQ ID NO: 146
  misc_feature: Useful for making plants with altered carbohydrate content

SEQ ID NO: 51626 - protein, 247 aa, Arabidopsis thaliana
  misc_feature: Useful for making plants with altered cell wall content and/or composition
MATTPLLLLLLTAVFLSTEITAQRAAPAPGPAGPINITAILEKGGQFVTLIRLLNTTQIGNQINIQINSSSEGMTVLAPTDNAFQNLKPGTLNKLSPDDQVKLILYHVSPKFYTLEDLLSVSNPVRTQASGRDVGGVYGLNFTGQGNQVNVSTGVVETRLSTSLRQERPLAVYVVDMVLLPEEMFGERKISPMAPPPKSKSPDVSDDSESSKKAAAPSESEKSGSGEMNTGLGLGLGLVVLCLKFLL

SEQ ID NO: 51627 - protein, 142 aa, Arabidopsis thaliana; identical to SEQ ID NO: 9670
  misc_feature: Useful for making plants with modulated nitrogen use efficiency

SEQ ID NO: 51628 - protein, 527 aa, Panicum virgatum; identical to SEQ ID NO: 6794
  misc_feature: Useful for making plants with altered carbohydrate content

SEQ ID NO: 51629 - protein, 510 aa, Panicum virgatum
  misc_feature: Useful for making plants with altered carbohydrate content
MSCSVRSSPLQGRMALNRLFVLFLGTALPLLFFFSLADAGKVGVSYGRLGNNLPSTASVVKLLKQSGITTVRLYDANPRVLKALANTGITVMVMLPNDHLAAAAADPASARRWVLRNVAAHYPATRIHGVAVGNEVFEEASNLTRQLVPAMANVHAALVRLGLDEAVKVSTPLAFTALQESWPPSAGRFRDDIARPVMKPMLDFLERTGSYLTVNAYPFFAYVEQPDKISLDYALGSAKAGVQDPVTGLVYHSLLDAQLDATFFAMEKLGSSGAWQGNSLGRGTPRARAYVSESGWPSGGSRRSGRSLDLEAGGGAGAPAATIANAKAYNNYLINRVLSCDTGTPYRPDADMDVYIFALFNENDKGCGADDIEQHFGLFYPNRTKVYEFDFRGAAPPAPAPAPSASSWCVANASAGEARLQATLDWACGHGADCSDIQPGAPCFEPDTVVAHASHAFNSYYQRSGRASGTCDFAGAAYVVYHAPKIGNCVLPSQVWIQEAAAKSEGYAAI

SEQ ID NO: 51630 - protein, 457 aa, Arabidopsis thaliana
  misc_feature: Useful for making plants with modulated nitrogen use efficiency
MASLGQITLPRAPSSEIGLLRRRFERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSYVKEVRGEGLIIGVELDVPASSLVDACRDSGLLILTAGKGNVVRIVPPLVISEEEIERAVEIMAQNLTALD

SEQ ID NO: 51631 - protein, 562 aa, Arabidopsis thaliana
  misc_feature: Useful for making plants with altered cell wall content and/or composition
MLTKTNDSRLIDRSSGFDQRTGIYHSLRPSLSLPPIDQPLSAAEFALSLLLKSSPPATAGKNIEALTYLVNSSSGDNLTYGELLRRVRSLAVSLRERFPSLASRNVAFILSPSSLDIPVLYLALMSIGVVVSPANPIGSESEVSHQVEVSEPVIAFATSQTVKKLQSSSLPLGTVLMDSTEFLSWLNRSDSSSVNPFQVQVNQSDPAAILFSSGTTGRVKGVLLTHRNLIASTAVSHQRTLQDPVNYDRVGLFSLPLFHVFGFMMMIRAISLGETLVLLGRFELEAMFKAVEKYKVTGMPVSPPLIVALVKSELTKKYDLRSLRSLGCGGAPLGKDIAERFKQKFPDVDIVQGYGLTESSGPAASTFGPEEMVKYGSVGRISENMEAKIVDPSTGESLPPGKTGELWLRGPVIMKGYVGNEKASAETVDKEGWLKTGDLCYFDSEDFLYIVDRLKELIKYKAYQVPPVELEQILHSNPDVIDAAVVPFPDEDAGEIPMAFIVRKPGSNLNEAQIIDFVAKQVTPYKKVRRVAFINAIPKNPAGKILRRELTKIAVDGNASKL

SEQ ID NO: 51632 - protein, 565 aa, Arabidopsis thaliana
  misc_feature: Useful for making plants with altered cell wall content and/or composition
MTTVHTFSILLFFCSLFSASLIIAKVQHHDFVIQETPVKRLCKTRNAITVNGMFPGPTLEVNNGDTLEVKVHNRARYNITIHWHGVRQIRTGWADGPEFVTQCPIRPGKSYTYRFTIQGQEGTLWWHAHSSWLRATVYGALIIHPTPGSSFPFPKPDRQTALMLGEWWNANPVDVINQATRTGAAPNISDAYTINGQPGDLYNCSTKETVVVPINSGETSLLRVINAALNQPLFFTVANHKLTVVGADASYLKPFTTKVLMLGPGQTTDVLLTADQPPKRYYIAARAYQSAQNAPFDNTTTTAILQYKKTTTTSKPIMPVLPAFNDTNTVTSFSRKFKSLRNVVVPKTIDDNLFFTIGLGLDNCPKKFPKSRCQGLNGTRFTASMNNVSFVLPSNFSLLQAHSNGIPGVFTTDFPSKPPVKFDYTGNNISRALFQPVKGTKLYKLKYGSRVQVVLQDTNIVTSENHPIHLHGYDFYIVGEGFGNFNPKKDTSKFNLVDPPLRNTVAVPVNGWAVIRFVADNPGVWLMHCHLDVHIKWGLAMAFLVDNGVGELETLEAPPHDLPIC

SEQ ID NO: 51633 - protein, 605 aa, Panicum virgatum; identical to SEQ ID NO: 7082
  misc_feature: Useful for making plants with altered carbohydrate content

SEQ ID NO: 51634 - protein, 333 aa, Arabidopsis thaliana [sequence omitted]

SEQ ID NO: 51635 - protein, 337 aa, Panicum virgatum; identical to SEQ ID NO: 5022
  misc_feature: Useful for making plants with altered carbohydrate content

SEQ ID NO: 51636 - protein, 481 aa, Arabidopsis thaliana
  misc_feature: Useful for making plants with altered alkaloid content
MESTRSDPELDDDFSEIYKEYTGPASAVTNNNIQDKDKPVKQRSEERCDEEEEQLPDPNSVPTDFTSREAKVWEAKSKATERNWKKRKEEEMICKICGESGHFTQGCPSTLGANRKSQEFFERVPARDNNVRVLFTEKVMESIERETSCKIKLDEKFIIVSGKDRLILRKGVDAVHKVKEDGEMKSSSVSHRSRSRSPRRTSVGPSRARNSEPQRQQLPSHGSSSFPERSGRQDKFVDNRFREETRVRENQRNVPRGSPQAKAYGSDRARSRSTHSKSPGRPRYSGWDKPYDRQKPEVSGYRSERWDQERMGGSSDIQVSHQFERPPFPQTLEELELEYTRDALELEKKRDKEEDEENNKHRETIRELRESYMKKLAGLRGMNAKQWDDFLQLDAQRRQQQARQQNSGLSYGNYRQFPPYAEFDDGYSSNPPPYGGNNMPMDSKGRYPNHGDNYSSRHQDNNYGGFQRQRREEYGKAYNRY

SEQ ID NO: 51637 - protein, 322 aa, Arabidopsis thaliana
  misc_feature: Useful for making plants with altered cell wall content and/or composition
KNQSSFSIVALLLIFFSSSVFAQLQTNFYRKSCPNVETIVRNAVRQKFQQTFVTAPATLRLFFHDCFVRGCDASILLASPSEKDHPDDKSLAGDGFDTVAKAKQALDRDPNCRNKVSCADILALATRDVVVLTGGPNYPVELGRRDGRLSTVASVQHSLPQPSFKLDQLNTMFARHGLSQTDMIALSGAHTIGFAHCGKFSKRIYNFSPKRPIDPTLNIRYALQLRQMCPIRVDLRIAINMDPTSPNTFDNAYFKNLQKGMGLFTSDQVLFSDERSRSTVNSFASSEATFRQAFISAITKLGRVGVKTGNAGEIRRDCSRVN

SEQ ID NO: 51638 - protein, 527 aa, Oryza sativa subsp. japonica; identical to SEQ ID NO: 9533
  misc_feature: Useful for making plants with modulated phosphate use efficiency

SEQ ID NO: 51639 - protein, 729 aa, Arabidopsis thaliana
  misc_feature: Useful for making plants with altered cell wall content and/or composition
MVNKDDRIRPVHEADGEPLFETRRRTGRVIAYRFFSASVFVCICLIWFYRIGEIGDNRTVLDRLIWFVMFIVEIWFGLYWVVTQSSRWNPVWRFPFSDRLSRRYGSDLPRLDVFVCTADPVIEPPLLVVNTVLSVTALDYPPEKLAVYLSDDGGSELTFYALTEAAEFAKTWVPFCKKFNVEPTSPAAYLSSKANCLDSAAEEVAKLYREMAARIETAARLGRIPEEARVKYGDGFSQWDADATRRNHGTILQVLVDGREGNTIAIPTLVYLSREKRPQHHHNFKAGAMNALLRVSSKITCGKIILNLDCDMYANNSKSTRDALCILLDEKEGKEIAFVQFPQCFDNVTRNDLYGSMMRVGIDVEFLGLDGNGGPLYIGTGCFHRRDVICGRKYGEEEEEEESERIHENLEPEMIKALASCTYEENTQWGKEMGVKYGCPVEDVITGLTIQCRGWKSAYLNPEKQAFLGVAPTNLHQMLVQQRRWSEGDFQIMLSKYSPVWYGKGKISLGLILGYCCYCLWAPSSLPVLIYSVLTSLCLFKGIPLFPKVSSSWFIPFGYVTVAATAYSLAEFLWCGGTFRGWWNEQRMWLYRRTSSFLFGFMDTIKKLLGVSESAFVITAKVAEEEAAERYKEEVMEFGVESPMFLVLGTLGMLNLFCFAAAVARLVSGDGGDLKTMGMQFVITGVLVVINWPLYKGMLLRQDKGKMPMSVTVKSVVLALSACTCLAFL

SEQ ID NO: 51640 - protein, 532 aa, Arabidopsis thaliana
  misc_feature: Useful for making plants with altered cell wall content and/or composition
MQLHISPSMRSITISSSNEFIDLMKIKVAARHISYRTLFHTILILAFLLPFVFILTAVVTLEGVNKCSSIDCLGRRIGPRLLGRVDDSERLARDFYKILNEVSTQEIPDGLKLPNSFSQLVSDMKNNHYDAKTFALVLRAMMEKFERDMRESKFAELMNKHFAASSIPKGIHCLSLRLTDEYSSNAHARRQLPSPEFLPVLSDNAYHHFILSTDNILAASVVVSSAVQSSSKPEKIVFHIITDKKTYAGMHSWFALNSVAPAIVEVKGVHQFDWLTRENVPVLEAVESHNGVRDYYHGNHVAGANLTETTPRTFASKLQSRSPKYISLLNHLRIYIPELFPNLDKVVFLDDDIVVQGDLTPLWDVDLGGKVNGAVETCRGEDEWVMSKRLRNYFNFSHPLIAKHLDPEECAWAYGMNIFDLQAWRKTNIRETYHSWLRENLKSNLTMWKLGTLPPALIAFKGHVHIIDSSWHMLGLGYQSKTNIENVKKAAVIHYNGQSKPWLEIGFEHLRPFWTKYVNYSNDFIKNCHILE

SEQ ID NO: 51641 - protein, 187 aa, Arabidopsis thaliana; identical to SEQ ID NO: 9691
  misc_feature: Useful for biocontainment applications
  misc_feature: Useful for making plants with modulated biomass

SEQ ID NO: 51642 - protein, 272 aa, Oryza sativa
  misc_feature: Useful for biocontainment applications
MHIYKEQEAEPSTGLMMPEPAPVASPGSGGSGGSGSVGAEKIGSRGKIEIKRIENTTNRQVTFCKRRSGLLKKAYELSVLCDAEVALVVFSSRGRLYEYSNNSVKETIERYKKANSDTSNASTVAEINAQHYQQEAAKLKQQITNLQNSNRTLVGDNITTMNHRELKQLEGRLDKGLGKIRARKNELLCAEIEYMQRRETELQNDNMYLKSKVAESERGLQTVNMMGSASTSEYVQNMIHYDPRNFLQFNIMHQPQYYPEQEDRKAFMSDER

SEQ ID NO: 51643 - protein, 856 aa, Arabidopsis thaliana
  misc_feature: Useful for making plants with altered cell wall content and/or composition
MREMGTGDSASRLILWFCLGFLILGVGFVQCGVTYDRKALLINGQRRILFSGSIHYPRSTPDMWEDLIQKAKDGGIDVIETYVFWNLHEPSPGKYDFEGRNDLVRFVKTIHKAGLYAHLRIGPYVCAEWNFGGFPVWLKYVPGISFRTDNEPFKRAMKGFTERIVELMKSENLFESQGGPIILSQIENEYGRQGQLLGAEGHNYMTWAAKMAIATETGVPWVMCKEDDAPDPVINTCNGFYCDSFAPNKPYKPLIWTEAWSGWFTEFGGPMHHRPVQDLAFGVARFIQKGGSFVNYYMYHGGTNFGRTAGGPFVTTSYDYDAPIDEYGLIRQPKYGHLKELHRAIKMCEKALVSADPVVTSIGNKQQAHVYSAESGDCSAFLANYDTESAARVLFNNVHYNLPPWSISILPDCRNAVFNTAKVGVQTSQMEMLPTDTKNFQWESYLEDLSSLDDSSTFTTHGLLEQINVTRDTSDYLWYMTSVDIGDSESFLHGGELPTLIIQSTGHAVHIFVNGQLSGSAFGTRQNRRFTYQGKINLHSGTNRIALLSVAVGLPNVGGHFESWNTGILGPVALHGLSQGKMDLSWQKWTYQVGLKGEAMNLAFPTNTPSIGWMDASLTVQKPQPLTWHKTYFDAPEGNEPLALDMEGMGKGQIWVNGESIGRYWTAFATGDCSHCSYTGTYKPNKCQTGCGQPTQRWYHVPRAWLKPSQNLLVIFEELGGNPSTVSLVKRSVSGVCAEVSEYHPNIKNWQIESYGKGQTFHRPKVHLKCSPGQAIASIKFASFGTPLGTCGSYQQGECHAATSYAILERKCVGKARCAVTISNSNFGKDPCPNVLKRLTVEAVCAPETSVSTWRP

SEQ ID NO: 51644 - protein, 261 aa, Zea mays
  misc_feature: Useful for making plants with modulated biomass
MASPSSTSNNSAFSPVAASAGTTMPGAGAPCAACKFLRRKCLPGCVFAPYFPPEEPQKFANVHKVFGASNVTKLLNELLPHQREDAVSSLAYEAEARVKDPVYGCVGAISVLQRQVHRLQKELDAAHAELLRYACGDVAAGIPTALPVVSAAPRLSTAPMTTTSPGQFAAGMYGSGRRLGVVDGLAAPPLPPSGGGGGCYFMRNHHNNVVISSSPGADVAPVLPYASVANWAVNAISASTTTTSGSESIGLDHKEGGDSSM

SEQ ID NO: 51645 - protein, 455 aa, Arabidopsis thaliana
  misc_feature: Useful for making plants with altered cell wall content and/or composition
MKMPVALVWLLAFTILLISGEGNNAICKENFKLDPRPHSVSILEFGAVGDGKTLNTIAFQNAVFYLKSFADKGGAQLYVPPGKWLTGSFNLTSHLTLFLEKGATILASPDPSHWDVVSPLPSYGRGIELPGKRYRSLINGDNLIDVVITGENGTFDGQGAAWWEWLESGSLNYSRPHIIEFVSSKHILISNLTFLNAPAINIHPVYCSQIHIRKVLIETSVDSPHVLGVAPDSSDNVCIEDSTINVGHDAVSLKSGWDQYGIHYGRPTTAVHIRNLRLKSPTGAGISFGSEMSGGVSDVTVERLNIHSSLIGVAFRTTRGRGGYIRNITISDVDLTSVDTAIVANGHTGSHPDDKFDRDALPVVTHIVMRNFTGVDIGVAGNLTGIGESPFTSICLADIHLQTRSEESWICSNVSGFSDDVSPEPCQELMSSPSSCFAGGSIYEGDATAQSYYSW

SEQ ID NO: 51646 - protein, 101 aa, Arabidopsis thaliana
  misc_feature: Useful for making plants with altered alkaloid content
  misc_feature: Useful for making plants with modulated nitrogen use efficiency
MAKLITSFLLLTILFTFVCLTMSKEAEYHPESYGPGSLKSYQCGGQCTRRCSSTKYHKPCMFFCQKCCAKCLCVPPGTYGNKQVCPCYNNWKTQQGGPKCP

SEQ ID NO: 51647 - protein, 418 aa, Zea mays
  misc_feature: Useful for making plants with modulated heat sensitivity
  misc_feature (402)..(402): Xaa is any aa, unknown, or other
MAVSFANLNSEAGLKKLDEYLLTRSYITGYQASKDEEEMGDKEEEAELDGRGGNGVEDEFLKIDELTEFLEKGEEEEYGDGAKRREKSVKNWMVESDNEDEDEDQLDLEDFEDDDEDGEAGGGDILYKDFFESGHNKQAKKRDGSTKKVQFKDEAHEVELHDSENDDGNDEQEHGLSTHEKERLKMRTKIEQMEKANLEPSTWTMQGEVTASRRPKNSALEVDLDFEHNVRPAPVITEEVTASLEEMIKKRIAESHFDDVEKPSLLPSKAPKEHKELDETKSKKGLAELYEDDYAQKAGIAPAPLSISDELKEEANTLFKRICLKLDALSHFHFAPKPVIEDMSVQANVPALAMEEIAPVAVSDAAMLAPEEIFEGKGDVKEEGELTQAERKRRRANKKRRXAASHKERTAPAKLQKD

SEQ ID NO: 51648 - protein, 310 aa, Arabidopsis thaliana
  misc_feature: Useful for making plants with altered cell wall content and/or composition
MRAIAAWFFIFCYLVPSVFAQLRHGFYEGTCPPAESIVGRVVFNHWDRNRTVTAALLRMQFHDCVVKGCDASLLIDPTTERPSEKSVGRNAGVRGFEIIDEAKKELELVCPKTVSCADIVTIATRDSIALAGGPKFKVRTGRRDGLRSNPSDVKLLGPTVSVATSIKAFKSIGFNVSTMVALIGGGHTVGVAHCSLFQDRIKDPKMDSKLRAKLKKSCRGPNDPSVFMDQNTPFRVDNEIYRQMIQQRAILRIDDNLIRDGSTRSIVSDFAYNNKLFKESFAEAMQKMGEIGVLTGDSGEIRTNCRAFNN

SEQ ID NO: 51649 - protein, 481 aa, Arabidopsis thaliana
  misc_feature: Useful for making plants with altered cell wall content and/or composition
MVKICCIGAGYVGGPTMAVMALKCPEIEVVVVDISEPRINAWNSDRLPIYEPGLEDVVKQCRGKNLFFSTDVEKHVFESDIVFVSVNTPTKTQGLGAGKAADLTYWESAARMIADVSKSSKIVVEKSTVPVRTAEAIEKILTHNSKGIEFQILSNPEFLAEGTAIKDLYNPDRVLIGGRDTAAGQKAIKALRDVYAHWVPVEQIICTNLWSAELSKLAANAFLAQRISSVNAMSALCEATGADVTQVAHAVGTDTRIGPKFLNASVGFGGSCFQKDILNLIYICECNGLPEAANYWKQVVKVNDYQKIRFANRVVSSMFNTVSGKKIAILGFAFKKDTGDTRETPAIDVCNRLVADKAKLSIYDPQVLEEQIRRDLSMARFDWDHPVPLQQIKAEGISEQVNVVSDAYEATKDAHGLCVLTEWDEFKSLDFKKIFDNMQKPAFVFDGRNVVDAVKLREIGFIVYSIGKPLDSWLKDMPAVA

SEQ ID NO: 51650 - protein, 390 aa, Arabidopsis thaliana
  misc_feature: Useful for making plants with altered cell wall content and/or composition
MRLRFPMKSAVLAFAIFLVFIPLFSVGIRMIPGRLTAVSATVGNGFDLGSFVEAPEYRNGKECVSQSLNRENFVSSCDASLVHVAMTLDSEYLRGSIAAVHSMLRHASCPENVFFHLIAAEFDPASPRVLSQLVRSTFPSLNFKVYIFREDTVINLISSSIRQALENPLNYARNYLGDILDPCVDRVIYLDSDIIVVDDITKLWNTSLTGSRIIGAPEYCHANFTKYFTSGFWSDPALPGFFSGRKPCYFNTGVMVMDLVRWREGNYREKLETWMQIQKKKRIYDLGSLPPFLLVFAGNVEAIDHRWNQHGLGGDNVRGSCRSLHKGPVSLLHWSGKGKPWVRLDEKRPCPLDHLWEPYDLYEHKIERAKDQSLFGFSSLSELTEDSSFF

SEQ ID NO: 51651 - protein, 374 aa, Panicum virgatum; identical to SEQ ID NO: 4086
  misc_feature: Useful for making plants with altered carbohydrate content

SEQ ID NO: 51652 - protein, 428 aa, Arabidopsis thaliana
  misc_feature: Useful for biocontainment applications
MADSFELIVTRKEPVLVSPASETPKGLHYLSNLDQNIAIIVKTFYYFKSNSRSNEESYEVIKKSLSEVLVHYYPAAGRLTISPEGKIAVDCTGEGVVVVEAEANCGIEKIKKAISEIDQPETLEKLVYDVPGARNILEIPPVVVQVTNFKCGGFVLGLGMNHNMFDGIAAMEFLNSWAETARGLPLSVPPFLDRTLLRPRTPPKIEFPHNEFEDLEDISGTGKLYSDEKLVYKSFLFGPEKLERLKIMAETRSTTFQTLTGFLWRARCQALGLKPDQRIKLLFAADGRSRFVPELPKGYSGNGIVFTYCVTTAGEVTLNPLSHSVCLVKRAVEMVNDGFMRSAIDYFEVTRARPSLTATLLITSWAKLSFHTKDFGWGEPVVSGPVGLPEKEVILFLPCGSDTNYQCAAWTSWLGYESVPRDYGYMNH

SEQ ID NO: 51653 - protein, 320 aa, Arabidopsis thaliana; identical to SEQ ID NO: 9615
  misc_feature: Useful for making plants with altered alkaloid content

SEQ ID NO: 51654 - protein, 491 aa, Panicum virgatum; identical to SEQ ID NO: 5542
  misc_feature: Useful for making plants with altered carbohydrate content

SEQ ID NO: 51655 - protein, 534 aa, Arabidopsis thaliana
  misc_feature: Useful for making plants with altered cell wall content and/or composition
MAIKLIALVITICVASWDSAQGRSLRFSTTPLNRYSFPPHFDFGVASSAYQYEGAVEEGGRSPSIWDNFTHAFPERTNMDNGDVAVDFYHRYKDDIKLIKEMNMDSFRFSLSWSRILPSGKLSDGVNKEGVQFYKNLIDELIKNGIKPFVTIYHWDIPQALDDEYGSFLSPRIIDDFRNFARFCFQEFGDKVSMWTTFNEPYVYSVSGYDAGNKAIGRCSKWVNSLCIAGDSGTEPYLVSHNLLLAHAAAVEEFRKCDKISQDAKIGIVLSPYWFEPYDIDSESDKEAVERALVFNIGWHLSPLVFGDYPETIKTTAGNRLPSFTKEQSMMLQNSFDFIGINYYTARFVAHDLHVDLSRPRFTTDQHLQYKLTNRSGDHISSESDGTKILWSYPEGLRKLLNYIKNKYNNPTIYITENGFDDYENGSVTREEIIEDTKRIEYHQNHLQQLQKAITEDGCNVKGYFTWSLLDNFEWEHGYAVRFGLYYVDYKNGLSRHAKNSAKWFKHFLQRSGKPMPLDLFKSVKNWWSAIPMI

SEQ ID NO: 51656 - protein, 469 aa, Panicum virgatum; identical to SEQ ID NO: 6842
  misc_feature: Useful for making plants with altered carbohydrate content

SEQ ID NO: 51657 - protein, 497 aa, Arabidopsis thaliana
  misc_feature: Useful for making plants with altered cell wall content and/or composition
MDLQRGFVFLSLVLSFMIIETTAYRERQLLLLQPPQETAIDTANAVVTVQDRGLKTRRPEHKNAYATMMYMGTPRDYEFYVATRVLIRSLRSLHVEADLVVIASLDVPLRWVQTLEEEDGAKVVRVENVDNPYRRQTNFNSRFKLTLNKLYAWALSDYDRVVMLDADNLFLKKADELFQCGRFCAVFINPCIFHTGLFVLQPSVEVFKDMLHELQVGRKNPDGADQGFLVSYFSDLLDQPLFSPPSNGSVLNGHLRLPLGYQMDASYFYLKLRWNIPCGPNSVITFPGAVWLKPWYWWSWPVLPLGFSWHEQRRATIGYSAEMPLVIIQAMFYLGIIVVTRLARPNITKLCYRRSDRNLTTIQAGFKLIALLSVVAAYIFPFFTIPHTIHPLIGWSLYLMASFALSSISINTLLLPTLPVLTPWLGILGTLLVMAFPWYPDGVVRALSVFAYAFCCAPFVWVSFRKITSHLQVLIEKEVLFPRLGDSGVTSGFSKLY

SEQ ID NO: 51658 - protein, 240 aa, Arabidopsis thaliana
  misc_feature: Useful for biocontainment applications
  misc_feature: Useful for making plants with modulated biomass
  misc_feature: Useful for making plants with modulated flowering time
  misc_feature: Useful for making plants with modulated time to senescence
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 51659 - protein, 623 aa, Arabidopsis thaliana
  misc_feature: Useful for making plants with atered amino acid content
MEAVIQTRGLLSLPTKPIGVRSQLQPSHGLKQRLFAAKPRNLHGCLYPLTGTRNFKPLSQPCMGFRFPTKREAPSSYARRRRGCWRRSCLRRSDSAAVVASRKIFGVEVATLKKIIPLGLMFFCILFNYTILRDTKDVLVVTAKGSSAEIIPFLKTWVNLPMAIGFMLLYTKLSNVLSKKALFYTVIVPFIIYFGGFGFVMYPLSNYIHPEALADKLLTTLGPRFMGPIAILRIWSFCLFYVMAELWGSVVVSVLFWGFANQITTVDEAKKFYPLFGLGANVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 51660 - protein, 51 aa, Panicum virgatum; identical to SEQ ID NO: 7970
  misc_feature: Useful for making plants with altered carbohydrate content

SEQ ID NO: 51661 - protein, 205 aa, Panicum virgatum; identical to SEQ ID NO: 42950
  misc_feature: Useful for making plants with altered carbohydrate content

SEQ ID NO: 51662 - protein, 482 aa, Arabidopsis thaliana
  misc_feature: Useful for making plants with modulated water use efficiency
MPVVTRLIRLKCVGLRLDRSGLNRRICHGGHGESTRRRVMEELSSLTVSQREQFLVENDVFGIYNYFDASDVSTQKYMMEIQRDKQLDYLMKGLRQLGPQFSSLDANRPWLCYWILHSIALLGETVDDELESNAIDFLGRCQGSEGGYGGGPGQLPHLATTYAAVNALVTLGGDKALSSINREKMSCFLRRMKDTSGGFRMHDMGEMDVRACYTAISVASILNIMDDELTQGLGDYILSCQTYEGGIGGEPGSEAHGGYTYCGLAAMILINEVDRLNLDSLMNWAVHRQGVEMGFQGRTNKLVDGCYTFWQAAPCVLLQRLYSTNDHDVHGSSHISEGTNEEHHAHDEDDLEDSDDDDDSDEDNDEDSVNGHRIHHTSTYINRRMQLVFDSLGLQRYVLLCSKIPDGGFRDKPRKPRDFYHTCYCLSGLSVAQHAWLKDEDTPPLTRDIMGGYSNLLEPVQLLHNIVMDQYNEAIEFFFKAA

SEQ ID NO: 51663 - protein, 358 aa, Arabidopsis thaliana
  misc_feature: Useful for making plants with altered cell wall content and/or composition
MTKAYSTRVLTFLILISLMAVTLNLFPTVEAKKRSRDAPIVKGLSWNFYQKACPKVENIIRKELKKVFKRDIGLAAAILRIHFHDCFVQGCEASVLLAGSASGPGEQSSIPNLTLRQQAFVVINNLRALVQKKCGQVVSCSDILALAARDSVVLSGGPDYAVPLGRRDSLAFASQETTLNNLPPPFFNASQLIADFANRNLNITDLVALSGGHTIGIAHCPSFTDRLYPNQDPTMNQFFANSLKRTCPTANSSNTQVNDIRSPDVFDNKYYVDLMNRQGLFTSDQDLFVDKRTRGIVESFAIDQQLFFDYFTVAMIKMGQMSVLTGTQGEIRSNCSARNTQSFMSVLEEGIEEAISMI

SEQ ID NO: 51664 - protein, 343 aa, Panicum virgatum; identical to SEQ ID NO: 8936
  misc_feature: Useful for making plants with altered carbohydrate content

SEQ ID NO: 51665 - protein, 326 aa, Arabidopsis thaliana; identical to SEQ ID NO: 9390
  misc_feature: Useful for making plants with modulated drought sensitivity

SEQ ID NO: 51666 - protein, 159 aa, Arabidopsis thaliana; identical to SEQ ID NO: 9268
  misc_feature: Useful for making plants with modulated cold sensitivity

SEQ ID NO: 51667 - protein, 369 aa, Panicum virgatum; identical to SEQ ID NO: 864
  misc_feature: Useful for making plants with altered carbohydrate content

SEQ ID NO: 51668 - protein, 351 aa, Arabidopsis thaliana
  misc_feature: Useful for making plants with altered cell wall content and/or composition
MGSSVEQNILVTGGAGFIGTHTVVQLLKDGFKVSIIDNFDNSVIEAVDRVRELVGPDLSKKLDFNLGDLRNKGDIEKLFSKQRFDAVIHFAGLKAVGESVENPRRYFDNNLVGTINLYETMAKYNCKMMVFSSSATVYGQPEKIPCMEDFELKAMNPYGRTKLFLEEIARDIQKAEPEWRIILLRYFNPVGAHESGSIGEDPKGIPNNLMPYIQQVAVGRLPELNVYGHDYPTEDGSAVRDYIHVMDLADGHIAALRKLFADPKIGCTAYNLGTGQGTSVLEMVAAFEKASGKKIPIKLCPRRSGDATAVYASTEKAEKELGWKAKYGVDEMCRDQWKWANNNPWGYQNKL

SEQ ID NO: 51669 - protein, 192 aa, Arabidopsis thaliana
  misc_feature: Useful for making plants with modulated cold sensitivity
MCPVENKWLKVGQKGAGPGARSSHAMTVVGNKVYCFGGELKPTIHIDNDLYVFDLGTQEWSIAPATGEAPFPCFGVSMVTIGSTIYVYGGRDDKRRYNGLHSYDTETNEWKLLSPVEEGLPGRSYHSMAGDDRESLWWFRGVTAKGRVNTLHAYDVVDQKWVEYPAAGEACKGRGAPGLVVVEGRIWAFVWV

SEQ ID NO: 51670 - protein, 255 aa, Arabidopsis thaliana
  misc_feature: Useful for making plants with altered cell wall content and/or composition
MTKIFSLLVAMIFSTMFFMKISSVSAGWLQAHATFYGGSDASGTMGGACGYGNLYTDGYKTNTAALSTALFNDGKSCGGCYQILCDATKVPQWCLKGKSITITATNFCPPNFAQASDNGGWCNPPRPHFDMAQPAFLTIAKYKAGIVPILYKKVGCRRSGGMRFTINGRNYFELVLISNVAGGGEISKVWIKGSKSNKWETMSRNWGANYQSNTYLNGQSLSFKVQLSDGSIKAALNVVPSNWRFGQSFKSNVNF

SEQ ID NO: 51671 - protein, 361 aa, Panicum virgatum; identical to SEQ ID NO: 6494
  misc_feature: Useful for making plants with altered carbohydrate content

SEQ ID NO: 51672 - protein, 231 aa, Glycine max; identical to SEQ ID NO: 9195
  misc_feature: Useful for making plants with modulated flowering time

SEQ ID NO: 51673 - protein, 185 aa, Panicum virgatum; identical to SEQ ID NO: 43541
  misc_feature: Useful for making plants with altered carbohydrate content

SEQ ID NO: 51674 - protein, 253 aa, Arabidopsis thaliana
  misc_feature: Useful for making plants with altered cell wall content and/or composition
MFMGKMGLLGIALFCFAAMVCSVHGYDAGWVNAHATFYGGSDASGTMGGACGYGNLYSQGYGTNTAALSTALFNNGLSCGACFEIKCQSDGAWCLPGAIIVTATNFCPPNNALPNNAGGWCNPPLHHFDLSQPVFQRIAQYKAGVVPVSYRRVPCMRRGGIRFTINGHSYFNLVLVTNVGGAGDVHSVAVKGSRTRWQQMSRNWGQNWQSNNLLNGQALSFKVTASDGRTVVSNNIAPASWSFGQTFTGRQFR

SEQ ID NO: 51675 - protein, 351 aa, Arabidopsis thaliana
  misc_feature: Useful for making plants with altered cell wall content and/or composition
MSQHLLLLILLSLLLLHKPISATTIIQKFKEAPQFYNSADCPLIDDSESDDDVVAKPIFCSRRAVHVAMTLDAAYIRGSVAAVLSVLQHSSCPENIVFHFVASASADASSLRATISSSFPYLDFTVYVFNVSSVSRLISSSIRSALDCPLNYARSYLADLLPPCVRRVVYLDSDLILVDDIAKLAATDLGRDSVLAAPEYCNANFTSYFTSTFWSNPTLSLTFADRKACYFNTGVMVIDLSRWREGAYTSRIEEWMAMQKRMRIYELGSLPPFLLVFAGLIKPVNHRWNQHGLGGDNFRGLCRDLHPGPVSLLHWSGKGKPWARLDAGRPCPLDALWAPYDLLQTPFALDS

SEQ ID NO: 51676 - protein, 221 aa, Arabidopsis thaliana; identical to SEQ ID NO: 9269
  misc_feature: Useful for making plants with altered oil content

SEQ ID NO: 51677 - protein, 324 aa, Panicum virgatum; identical to SEQ ID NO: 6044
  misc_feature: Useful for making plants with altered carbohydrate content

SEQ ID NO: 51678 - protein, 194 aa, Arabidopsis thaliana
  misc_feature: Useful for making plants with altered cell wall content and/or composition
MVVMNKTNLLLLILSLFLAINLSSAQLRGDFYAGTCPNVEQIVRNAVQKKIQQTFTTIPATLRLYFHDCFVNGCDASVMIASTNTNKAEKDHEDNLSLAGDGFDTVIKAKEAVDAVPNCRNKVSCADILTMATRDVVNLAGGPQYAVELGRRDGLSSSASSVTGKLPKPTFDLNQLNALFAENGLSPNDMIALS

SEQ ID NO: 51679 - protein, 1680 aa, Arabidopsis thaliana
  misc_feature: Useful for making plants with altered cell wall content and/or composition
MAQNLDPNSDGRGVLQFKTGLMSVIKQKLAKRDGASIDRDRDIERLWEFYKLYKRRHRVDDIQKEEQKWRESGTTFSSNVGEILKMRKVFATLRALIEVLEVLSRDADPNGVGRSIRDELGRIKKADATLSAELTPYNIVPLEAQSMTNAIGVFPEVRGAVQAIRYTEHFPRLPVDFEISGQRDADMFDLLEYIFGFQRDNVRNQREHLVLTLSNAQSQLSIPGQNDPKIDENAVNEVFLKVLDNYIKWCKYLRIRVVYNKLEAIDRDRKLFLVSLYFLIWGEAANMAKELDAKLDHGEAVRADSCLTGTDTGSVSFLERIICPIYETISAETVRNNGGKAAHSEWRNYDDFNEYFWTPACFELSWPMKTESRFLSKPKGRKRSLTIIAFRNEHLNIETFKILLSAGPTYAIMNFIECLLDVVLMYGAYSMARGMAISRLVIRYVAFWLVVLASKFTFAYFLQARSFYSSNDHALTIVSLWAPVLAIYLMDIHIWYTLLSAIIGGVMGAKARLGEIRTIEMVHKRFESFPEAFAQNLVSPVVKRVPLGQHASQVSDKFKLSVLSLDVLIDILALLPYIDGQDMNKAYAAMFSPFWNEIIKSLREEDYLSNREMDLLSIPSNTGSLRLVQWPLFLLCSKILVAIDLAMECKETQEVLWRQICDDEYMAYAVQECYYSVEKILNSMVNDEGRRWYSISVCLNLNVCLICEDHISNSIEQGSLAITLNLKKLQLVVSRFTALTGLLIRNETPDLAKGAAKAMFDFYEVVTHDLLSHDLREQLDTWNILARARNEGRLFSRIAWPRDPEIIEQVKRLHLLLTVKDAAANVPKNLEARRRLEFFTNSLFMDMPQARPVAEMVPFSVFTPYYSETVLYSSSELRSENEDGISILFYLQKIFPDEWENFLERIGRSESTGDADLQASSTDALELRFWVSYRGQTLARTVRGMMYYRRALMLQSFLERRGLGVDDASLTNMPRGFESSIEARAQADLKFTYVVSCQIYGQQKQQKKPEATDIGLLLQRYEALRVAFIHSEDVGNGDGGSGGKKEFYSKLVKADIHGKDEEIYSIKLPGDPKLGEGKPENQNHAIVFTRGEAIQTIDMNQDNYLEEAIKMRNLLEEFHGKHGIRRPTILGVREHVFTGSVSSLAWFMSNQETSFVTLGQRVLAYPLNFLFICLHLLGKMGSALVFRVRMHYGHPDVFDRIFHITRGGISKASRVINISEDIYAGRDVGLNQIALFEGKVAGGNGEQVLSRDVYRIGQLFDFFRMMSFYFTTVGFYVCTMMTVLTVYVFLYGRVYLAFSGADRAISRVAKLSGNTALDAALNAQFLVQIGIFTAVPMVMGFILELGLLKAIFSFITMQFQLCSVFFTFSLGTRTHYFGRTILHGGAKYRATGRGFVVQHIKFADNYRLYSRSHFVKAFEVALLLIIYIAYGYTDGGASSFVLLTISSWFLVISWLFAPYIFNPSGFEWQKTVEDFEDWVSWLMYKGGVGVKGELSWESWWEEEQAHIQTLRGRILETILSLRFFMFQYGIVYKLDLTRKNTSLALYGYSWVVLVVIVFLFKGVASITFIALIVVAIAMTDLSIPDMFACVLGFIPTGWALLSLAITWKQVLRVLGLWETVREFGRIYDAAMGMLIFSPIALLSWFPFISTFQSRLLFNQAFSRGLEISIILAGNRANVET

SEQ ID NO: 51680 - protein, 280 aa, Arabidopsis thaliana; identical to SEQ ID NO: 9515
  misc_feature: Useful for making plants with modulated biomass

SEQ ID NO: 51681 - protein, 209 aa, Arabidopsis thaliana; identical to SEQ ID NO: 9731
  misc_feature: Useful for making plants with modulated flowering time

SEQ ID NO: 51682 - protein, 427 aa, Arabidopsis thaliana
  misc_feature: Useful for biocontainment applications
MGKVRQDSGSDDDNSIKKSFTKGPWTQAEDNLLIAYVDKHGDGNWNAVQNNSGLSRCGKSCRLRWVNHLRPDLKKGAFTEKEEKRVIELHALLGNKWARMAEELPGRTDNEIKNFWNTRLKRLQRLGLPVYPDEVREHAMNAATHSGLNTDSLDGHHSQEYMEADTVEIPEVDFEHLPLNRSSSYYQSMLRHVPPTNVFVRQKPCFFQPPNVYNLIPPSPYMSTGKRPREPETAFPCPGGYTMNEQSPRLWNYPFVENVSEQLPDSHLLGNAAYSSPPGPLVHGVENFEFPSFQYHEEPGGWGADQPNPMPEHESDNTLVQSPLTAQTPSDCPSSSLYDGLLESVVYGSSGEKPATDTDSESSLFQSFTPANENITGKTCFLTLYALHALHCLCNQFKKSPLLHLHDKLNWCNKFRFNSFKSGTHIL

SEQ ID NO: 51683 - protein, 350 aa, Glycine max
  misc_feature: Useful for making plants with modulated flowering time
MMLGEHHRGNPTVLVPPWPAHDDPTAEMYSAFLTNDVNAGEYSPYHLQEALTALQRFLPSNETDADSDSSEAAQPDAAVDAYTCDHFRMYEFKVRRCARGRSHDWTECPYAHPGEKARRRDPRRFHYSGVACPEFRKGNCRKGDACEFAHGVFECWLHPARYRTQPCKDGTSCRRRVCFFAHTPEQLRVLPMQSPRSVANSSESYDGSPMRQVSLSSAAAAAFMSSPAASLSPPESPPSVNEMVASLRNLQLGKMKSMPHNRNVSVGSPRGSVLRPGFLSLPTTPTQQPVRSGVKCFDVWDESFEEEPVMERVESGRGIRAKMFEKLSKENSLDASASPPDLGWVSELVK

SEQ ID NO: 51684 - protein, 359 aa, Arabidopsis thaliana; identical to SEQ ID NO: 9307
  misc_feature: Useful for making plants with modulated nitrogen use efficiency

SEQ ID NO: 51685 - protein, 216 aa, Panicum virgatum; identical to SEQ ID NO: 44311
  misc_feature: Useful for making plants with altered carbohydrate content

SEQ ID NO: 51686 - protein, 400 aa, Panicum virgatum; identical to SEQ ID NO: 6322
  misc_feature: Useful for making plants with altered carbohydrate content

SEQ ID NO: 51687 - protein, 87 aa, Arabidopsis thaliana; identical to SEQ ID NO: 9228
  misc_feature: Useful for making plants with altered oil content

SEQ ID NO: 51688 - protein, 194 aa, Panicum virgatum
  misc_feature: Useful for making plants with altered carbohydrate content
MARMALAAALVAVAVAGVLAGGARAQLVEGFYASCCPQAEKIIKNYVAEHVPRVPTIAATLLRTHFHDCFVRGCDASLLLNATGGKEAEKDAAPNKTLRGFAFIDRIKAIIEKECPGVVSCADILALAARDSVVVTGGPSWSVPTGRRDGTVSLKQEALDNIPGPTMNFTQLLQSFQNKSLSLADLVWLSAGVW

SEQ ID NO: 51689 - protein, 314 aa, Arabidopsis thaliana
  misc_feature: Useful for making plants with altered lignin content
MRFLHRFLLEDMPKETFSDSLCKNNCIQELKTLGYCSSYCLDECPSICEIVVISGLSPPAEIHHDDNLKRILIISASSIITTLFLLTLLVLCFKFYYRRRRSITTSRRWSMEEARNWDFDGPAPVIVDHPIWHIRTIGLNPTVISSIKVCQYSKKDGVVEGTDCSVCLSEFEEEETLRLLPKCKHAFHLYCIDTWLRSHTNCPLSRAPIVEANTMIDDHSEGLEEISVMIPEENGDDTDEEIEEERDGFVSNISRDHGESQQQRVRRSVSLDSLSGLRVSEVVVGREKEKLKRGNNIGSGRSSLLKRSISYSGK

SEQ ID NO: 51690 - protein, 421 aa, Arabidopsis thaliana; identical to SEQ ID NO: 9506
  misc_feature: Useful for making plants with modulated flowering time

SEQ ID NO: 51691 - protein, 401 aa, Arabidopsis thaliana
  misc_feature: Useful for making plants with modulated low light sensitivity
  misc_feature: Useful for making plants with modulated nitrogen use efficiency
MDLSDIRNNNNDTAAVATGGGARQLVDASLSIVPRSTPPEDSTLATTSSTATATTTKRSTKDRHTKVDGRGRRIRMPALCAARVFQLTRELGHKSDGETIEWLLQQAEPAIVAATGTGTIPANFSTLSVSLRSSGSTLSAPPSKSVPLYGALGLTHHQYDEQGGGGVFAAHTSPLLGFHHQLQHHQNQNQNQDPVETIPEGENFSRKRYRSVDLSKENDDRKQNENKSLKESETSGPTAAPMWAVAPPSRSGAGNTFWMLPVPTTAGNQMESSSNNNTAAGHRAPPMWPFVNSAGGGAGGGGGAATHFMAGTGFSFPMDQYRGSPLQLGSFLAQPQPTQNLGLSMPDSNLGMLAALNSAYSRGGNANANAEQANNAVEHQEKQQQSDHDDDSREENSNSSE

SEQ ID NO: 51692 - protein, 427 aa, Zea mays; identical to SEQ ID NO: 9529
  misc_feature: Useful for making plants with altered terpenoid content

SEQ ID NO: 51693 - protein, 616 aa, Arabidopsis thaliana
  misc_feature: Useful for making plants with altered cell wall content and/or composition
MMVKLRNLVLFFMLLTVVAHILLYTDPAASFKTPFSKRDFLEDVTALTFNSDENRLNLLPRESPAVLRGGLVGAVYSDKNSRRLDQLSARVLSATDDDTHSHTDISIKQVTHDAASDSHINRENMHVQLTQQTSEKVDEQPEPNAFGAKKDTGNVLMPDAQVRHLKDQLIRAKVYLSLPSAKANAHFVRELRLRIKEVQRALADASKDSDLPKTAIEKLKAMEQTLAKGKQIQDDCSTVVKKLRAMLHSADEQLRVHKKQTMFLTQLTAKTIPKGLHCLPLRLTTDYYALNSSEQQFPNQEKLEDTQLYHYALFSDNVLATSVVVNSTITNAKHPLKHVFHIVTDRLNYAAMRMWFLDNPPGKATIQVQNVEEFTWLNSSYSPVLKQLSSRSMIDYYFRAHHTNSDTNLKFRNPKYLSILNHLRFYLPEIFPKLSKVLFLDDDIVVQKDLSGLWSVDLKGNVNGAVETCGESFHRFDRYLNFSNPLISKNFDPRACGWAYGMNVFDLDEWKRQNITEVYHRWQDLNQDRELWKLGTLPPGLITFWRRTYPLDRKWHILGLGYNPSVNQRDIERAAVIHYNGNLKPWLEIGIPRYRGFWSKHVDYEHVYLRECNINP

SEQ ID NO: 51694 - protein, 385 aa, Panicum virgatum
  misc_feature: Useful for making plants with altered carbohydrate content
MQDDCSIVVKKLRAMLHSAEEQLHAHKKQTVLLTQLAAKTLPKGLHCLPLRLANEYFSLDPDRQQFPNQNKLTNPKLYHYALFSDNILATAVVVNSTVLNAKHPSDHVFHIVTDRLNYAPMRMWFLSNPPGKATIEVQNTGEFTWLNDSYSPVLKQLGSQSMIDYYFGTNRANPDSNLKYRNSKYLSILNHLRFYLPEIYPKLDKMVFLDDDIVVKKDLTGLWSINMKGKVNGAVETCGESFHRFDRYLNFSNPGIAKNFDPHACGWAFGMNVFDLAEWKRQNITQIYHSWQKLNQDRSLWKFGTLPPGLITFWNKTFPLSRSWHVLGLGYNPHVNSRDIERAAVIHYNGNMKPWLEIGLPKFRSYWSKYLDYDQPFLRECNINP

SEQ ID NO: 51695 - protein, 380 aa, Arabidopsis thaliana
  misc_feature: Useful for making plants with altered cell wall content and/or composition
MSAILAAAIGGAVGALALIALFVFLLWFCVFRRKNLSRTSETGSSDPSTQEGRNVAIELSMREARRFEMEELAQATKSFTNKSLIGIGKFGEVYKGLLQDGVLVAIKKRPGLPTQEFVNEVRYLSSIHHRNLVTLLGFCQESNTQFLVYEYVPNGSVSSHLYGAGGKVPGNRLEFRHRLAISIGAAKGLAHLHSLSPRLIHKDFKTANVLVDENFIAKVADAGVRNFLGREDVGTSSHIVADQIFLSPEVQEFKRFSEKSDVYAFGVFLLELVSGREASEPSPSSSTQTLVDWMQNLTDYADIPMMIDERLGGTYTAEGVEELITLTLRCVDVSSEKRPTMSFVVTELERILDKEVSLTTVMGEGTPTVTLGSQLFKATK

SEQ ID NO: 51696 - protein, 289 aa, Panicum virgatum; identical to SEQ ID NO: 3682
  misc_feature: Useful for making plants with altered carbohydrate content

SEQ ID NO: 51697 - protein, 589 aa, Arabidopsis thaliana
  misc_feature: Useful for making plants with modulated flowering time
MASYRPPYPPLPQPPSQNSLAPPPPPPSLPPPVPPPPPSHQPYSYPPPPPPPPHAYYQQGPHYPQFNQLQAPPPPPPPSAPPPLVPDPPRHQGPNDHEKGASKQVGRRERAKPDPSKHHHRSHLPHSKKIETEEERRLRKKRELEKQRQDEKHRQQMKNSHKSQMPKGHTEEKKPTPLLTTDRVENRLKKPTTFICKLKFRNELPDPSAQLKLMTIKRDKDQFTKYTITSLEKLWKPKIFVEPDLGIPLDLLDLSVYNPPKVKAPLAPEDEELLRDDDAVTPIKKDGIRRKERPTDKGMSWLVKTQYISSINNESARQSLTEKQAKELREMKGGINILHNLNNRERQIKDIEASFEACKSRPVHATNKNLQPVEVLPLLPYFDRYDEQFVVANFDGAPIADSEFFGKLDPSIRDAHESRAILKSYVVAGSDTANPEKFLAYMVPSLDELSKDIHDENEEISYTWVREYLWDVQPNANDPGTYLVSFDNGTASYLPLPMRLNLRKKRAREGRSSDEIEHFPVPSRVTVRRRSTVSVIEHKDSGVYSSRVGASSSKMRRLEDEGGLGRSWKHEPEQDANQYSDGNEDDYSE

SEQ ID NO: 51698 - protein, 255 aa, Arabidopsis thaliana
  misc_feature: Useful for making plants with modulated salt sensitivity
MTRSVSFPLFLFAVVLSLSSSLLADDPKPIRREVYEGGKIYDISHRYTPEIPAWESSEGLGKTFLRLAASMKNGSFANVSEMKLSVHSGTHVDAPGHFWDNYYDAGFDTDSLDLQVLNGPALLVDVPRDKNITAEVMESLHIQRGVRRVLFRTSNTDKRLMFKKEFDSSFAGFMTDGAKWLVENTDIKLIGLDYLSFAAFEESPATHRVILKGRDIIPVEALKLDGVEVGTYSLHCLPLRLVGAEGAPTRCILIK

SEQ ID NO: 51699 - protein, 227 aa, Arabidopsis thaliana
  misc_feature: Useful for making plants with modulated heat sensitivity
MASTLSFAASALCSPLAPSPSVSSKSATPFSVSFPRKIPSRIRAQDQRENSIDVVQQGQQKGNQGSSVEKRPQQRLTMDVSPFGLLDPLSPMRTMRQMLDTMDRMFEDTMPVSGRNRGGSGVSEIRAPWDIKEEEHEIKMRFDMPGLSKEDVKISVEDNVLVIKGEQKKEDSDDSWSGRSVSSYGTRLQLPDNCEKDKIKAELKNGVLFITIPKTKVERKVIDVQIQ

SEQ ID NO: 51700 - protein, 192 aa, Arabidopsis thaliana; identical to SEQ ID NO: 9618
  misc_feature: Useful for making plants with altered terpenoid content

SEQ ID NO: 51701 - protein, 301 aa, Brassica napus; identical to SEQ ID NO: 9704
  misc_feature: Useful for making plants with altered terpenoid content
  misc_feature (32)..(32): Xaa is any aa, unknown, or other
  misc_feature (188)..(188): Xaa is any aa, unknown, or other
  misc_feature (202)..(202): Xaa is any aa, unknown, or other
  misc_feature (244)..(244): Xaa is any aa, unknown, or other
  misc_feature (266)..(266): Xaa is any aa, unknown, or other
  misc_feature (282)..(282): Xaa is any aa, unknown, or other
  misc_feature (296)..(296): Xaa is any aa, unknown, or other

SEQ ID NO: 51702 - protein, 894 aa, Arabidopsis thaliana
  misc_feature: Useful for making plants with altered cell wall content and/or composition
MSRISSVDVFENWFAQHKEKKLYIVLISLHGLIRGENMELGRDSDTGGQVKYVVELARALGSMPGVYRVDLLTRQVTAPDVDSSYSEPSEMLNPIDTDIEQENGESSGAYIIRIPFGPKDKYVPKELLWPHIPEFVDRALSHIMQISKVLGEQIGGGQQVWPVSIHGHYADAGDSTALLSGALNVPMVFTGHSLGRDKLEQLLKQGRPKEEINSNYKIWRRIEAEELCLDASEIVITSTRQEVDEQWRLYDGFDPVLERKLRARMKRGVSCLGRFMPRMVVIPPGMEFHHIVPHDVDADGDDENPQTADPPIWSEIMRFFSNPRKPMILALARPDPKKNLVTLVKAFGECRPLRELANLTLIMGNRNDIDELSSTNSSVLLSILKLIDKYDLYGQVAMPKHHQQSDVPEIYRLAAKTKGVFINPAFIEPFGLTLIEAGAHGLPTVATINGGPVDIHRVLDNGLLVDPHDQQAIADALLKLVSDRQLWGRCRQNGLNNIHLFSWPEHCKTYLARIASCKQRHPKWQRVEFENSDSDSPSDSLRDINDISLNLKLSLDGEKSGSNNGVDTNLDAEDRAAERKAEVEKAVSTLAQKSKPTEKFDSKMPTLKRRKNIFVISVDCSATSDLLAVVKTVIDAAGRGSSTGFILSTSMTISETHTALLSGGLKPQDFDAVICSSGSELYFTSSGSEDKTALPYTLDADYHSHIEFRWGGESLRKTLIRWISSVEEKKKTKKGEILVEDESSSTNYCLSFKVKDPALMPPMKELRKLMRNQALRCNAVYCQNGARLNVIPVLASRSQALRYLLVRWGIDLSNMVVFVGDSGDTDYEGLLGGIHKTVILKGLASDLREQPGNRSYPMEDVTPLNSPNITEAKECGRDAIKVALEKLGISLLKP

SEQ ID NO: 51703 - protein, 184 aa, Arabidopsis thaliana; identical to SEQ ID NO: 9273
  misc_feature: Useful for making plants with altered terpenoid content

SEQ ID NO: 51704 - protein, 819 aa, Arabidopsis thaliana; identical to SEQ ID NO: 9189
  misc_feature: Useful for making plants with modulated drought sensitivity

SEQ ID NO: 51705 - protein, 446 aa, Panicum virgatum; identical to SEQ ID NO: 3444
  misc_feature: Useful for making plants with altered carbohydrate content

SEQ ID NO: 51706 - protein, 461 aa, Arabidopsis thaliana
  misc_feature: Useful for making plants with altered cell wall content and/or composition
MIERCLGAYRCRRIQRALRQLKVTILCLLLTVVVLRSTIGAGKFGTPEQDLDEIRQHFHARKRGEPHRVLEEIQTGGDSSSGDGGGNSGGSNNYETFDINKIFVDEGEEEKPDPNKPYTLGPKISDWDEQRSDWLAKNPSFPNFIGPNKPRVLLVTGSAPKPCENPVGDHYLLKSIKNKIDYCRLHGIEIFYNMALLDAEMAGFWAKLPLIRKLLLSHPEIEFLWWMDSDAMFTDMAFELPWERYKDYNLVMHGWNEMVYDQKNWIGLNTGSFLLRNNQWALDLLDTWAPMGPKGKIREEAGKVLTRELKDRPVFEADDQSAMVYLLATQRDAWGNKVYLESGYYLHGYWGILVDRYEEMIENYHPGLGDHRWPLVTHFVGCKPCGKFGDYPVERCLKQMDRAFNFGDNQILQIYGFTHKSLASRKVKRVRNETSNPLEMKDELGLLHPAFKAVKVQTNQV

SEQ ID NO: 51707 - protein, 133 aa, Arabidopsis thaliana
  misc_feature: Useful for making plants with modulated biomass
MSGGSGSKHKIGGGKHGGLGGKFGKKRGMSGSGGGMSGSEGGVSGSEGSMSGGGMSGGSGSKHKIGGGKHGGLRGKFGKKRGMSGSEGGMSGSEGGVSESGMSGSGGGKHKIGGGKHKFGGGKHGGGGGHMAE

SEQ ID NO: 51708 - protein, 253 aa, Arabidopsis thaliana
  misc_feature: Useful for making plants with altered lignin content
MGGRENYLDLNNLPDDFSKDGNKQALEEGSSSGQRKKKGSKEGKDESGKVYECRFCSLKFCKSQALGGHMNRHRQERETETLNQARQLVYRNDTITPPGISPFGYHHTTDPTIYRSVYSSPMIYPGSSSTNLVPQPPMPPPPPPYPYSSNQYSPHNHFNDYYLNPSFRGSRSISPSPNLPTTTTVDYMADSPVEPGYTCVGAPIGPTGFPIRGPSIVRAPLEPPQGRDGDASRQRLDHSLRFPINRFQDHHSL

SEQ ID NO: 51709 - protein, 118 aa, Zea mays
  misc_feature: Useful for making plants with modulated nitrogen use efficiency
MGRGGGMGNPVNVGIAVQADWENREFISNISLNVRRLFDFLLRFGQLLFHSISPRPALSRSGSPTFGSGPPPSCFIPYHAELNCPCYPHITLPCPSLCLVIVGWQTIAQTTHETGCFN

SEQ ID NO: 51710 - protein, 48 aa, Arabidopsis thaliana
  misc_feature: Useful for making plants with modulated nitrogen use efficiency
MAGGCGGILVFVSGSIQLHGEDHPLRFSQVYLLSICNRFEGFIWLKQS

SEQ ID NO: 51711 - protein, 153 aa, Zea mays; identical to SEQ ID NO: 9359
  misc_feature: Useful for making plants with altered terpenoid content

SEQ ID NO: 51712 - protein, 134 aa, Arabidopsis thaliana; identical to SEQ ID NO: 9415
  misc_feature: Useful for making plants with altered lignin content

SEQ ID NO: 51713 - protein, 341 aa, Arabidopsis thaliana
  misc_feature: Useful for making plants with altered cell wall content and/or composition
MASSDKQTSPKPPPSPSPLRNSKFCQSNMRILISGGAGFIGSHLVDKLMENEKNEVIVADNYFTGSKDNLKKWIGHPRFELIRHDVTEPLLIEVDQIYHLACPASPIFYKYNPVKTIKTNVIGTLNMLGLAKRVGARILLTSTSEVYGDPLIHPQPESYWGNVNPIGVRSCYDEGKRVAETLMFDYHRQHGIEIRIARIFNTYGPRMNIDDGRVVSNFIAQALRGEALTVQKPGTQTRSFCYVSDMVDGLMRLMEGDDTGPINIGNPGEFTMVELAETVKELINPSIEIKMVENTPDDPRQRKPDITKAKEVLGWEPKVKLREGLPLMEEDFRLRLGVHKN

SEQ ID NO: 51714 - protein, 199 aa, Arabidopsis thaliana
  misc_feature: Useful for making plants with modulated biomass
  misc_feature (147)..(147): Xaa is any aa, unknown, or other
  misc_feature (148)..(148): Xaa is any aa, unknown, or other
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHXXQFFPREQMFGGLDVPAGNNYDGGILAIGQITQFQQPRAAAGDDGRRTVDPS

SEQ ID NO: 51715 - protein, 268 aa, Arabidopsis thaliana
  misc_feature: Useful for making plants with modulated biomass
  misc_feature: Useful for making plants with modulated flowering time
MSREREGFGEYYETVKKIKKDPAFETTTDHAVMGIRRHVAVPPGTTLNTVTPCAACKLLRRRCAEECPFSPYFSPHEPHKFAAVHKVFGASNVSKMLLEVGESQRGDAANSLVYEANLRLRDPIYGCMGAISALQHHIQSLQSELTTVRTEILRHKYQEATTITSLQNNFNSTTTTSSVSCDQHALASAILLPPPPPPPPTPRPPRLLSSQPAPPPTPPVSLPSPSMVVSSSSSSNSSATNSMYNPPPSSTAGYSNSLSSDNNVHYFD

SEQ ID NO: 51716 - protein, 218 aa, Arabidopsis thaliana
  misc_feature: Useful for biocontainment applications
MTSSSSSSGSPCGACKFLRRKCAKGCVFAPYFCHEQGASHFAAIHKVFGASNASKLLSHLPISDRCEAAITISYEAQARLQDPIYGCVSHIFALQQQVVNLQAELEILKQQAAQSMIFADSPTSENPNSYYGDTTKAPYHHDHQNIYHHHDQTHLVYQTGSSGTVQHGDATESSYHNETSSGMGEFSIYSDLEQHLNTFNQDHLKELQSANFGYISFS

SEQ ID NO: 51717 - protein, 755 aa, Arabidopsis thaliana
  misc_feature: Useful for making plants with altered cell wall content and/or composition
SEDASKSGTSLWAQCQALADMKFTFVVSCQQYSVQKRSGDQRAKDILRLMTTYPSLRVAYIDEVEQTHKESYKGADEKIYYSALVKAAPQTKSMDSSESVQTLDQVIYRIKLPGPAILGEGKPENQNHSIIFTRGEGLQTIDMNQDNYMEEAFKMRNLLQEFLVKHGGVRTPTILGLREHIFTGSVSSLAWFMSNQENSFVTIGQRVLASPLKVRFHYGHPDVFDRLFHLTRGGVCKASKVINLSEDIFAGFNSTLREGNVTHHEYIQVGKGRDVGLNQISMFEAKIANGNGEQTLSRDLYRLGHRFDFFRMLSCYFTTIGFYFSTMLTVLTVYVFLYGRLYLVLSGLEEGLSNQKAFRSNMPLQAALASQSFVQIGFLMALPMMMEIGLERGFHNALIDFVLMQLQLASVFFTFQLGTKTHYYGRTLFHGGAEYRGTGRGFVVFHAKFAENYRFYSRSHFVKGIELMILLLVYQIFGHAYRGVVTYILITVSIWFMVVTWLFAPFLFNPSGFEWQKIVDDWTDWNKWIYNRGGIGVPPEKSWESWWEKEIGHLRHSGKRGIILEIVLALRFFIFQYGLVYQLSTFKQENQSLWIYGASWFVILFILLIVKGLGVGRQRFSTNFQLLFRIIKGFVFLTFLGLLITFLALRFLTPKDIFLCMLAFMPTGWGMLLIAQACKPLIQRLGFWSSVRTLARGYEILMGLLLFTPVAFLAWFPFVSEFQTRMLFNQAFSRGLQISRILGGQRKDRSSKNKE

SEQ ID NO: 51718 - protein, 51 aa, Panicum virgatum; identical to SEQ ID NO: 46230
  misc_feature: Useful for making plants with altered carbohydrate content

SEQ ID NO: 51719 - protein, 155 aa, Arabidopsis thaliana; identical to SEQ ID NO: 9388
  misc_feature: Useful for making plants with modulated heat sensitivity

SEQ ID NO: 51720 - protein, 156 aa, Arabidopsis thaliana; identical to SEQ ID NO: 9432
  misc_feature: Useful for making plants with modulated drought sensitivity
  misc_feature: Useful for making plants with modulated water use efficiency

SEQ ID NO: 51721 - protein, 121 aa, Arabidopsis thaliana
  misc_feature: Useful for biocontainment applications
  misc_feature: Useful for making plants with modulated cold sensitivity
MGTGEKTLKSFQLHRKQSVKVKDVPKGCLAIKVGSQGEEQQRFIVPVLYFNHPLFMQLLKEAEDEYGFDQKGTITIPCHVEEFRYVQALIDGERSVYNGNNHHHRHGGRDQYHHLVGCFRA

SEQ ID NO: 51722 - protein, 175 aa, Arabidopsis thaliana
  misc_feature: Useful for making plants with modulated flowering time
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 51723 - protein, 577 aa, Arabidopsis thaliana
  misc_feature: Useful for making plants with modulated water use efficiency
MQHSLRSDLLPTKTSPRSHLLPQPKNANISRRILINPFKIPTLPDLTSPVPSPVKLKPTYPNLNLLQKLAATMLDKIESSIVIPMEQNRPLPKPTDPAVQLSGNFAPVNECPVQNGLEVVGQIPSCLKGVYIRNGANPMFPPLAGHHLFDGDGMIHAVSIGFDNQVSYSCRYTKTNRLVQETALGRSVFPKPIGELHGHSGLARLALFTARAGIGLVDGTRGMGVANAGVVFFNGRLLAMSEDDLPYQVKIDGQGDLETIGRFGFDDQIDSSVIAHPKVDATTGDLHTLSYNVLKKPHLRYLKFNTCGKKTRDVEITLPEPTMIHDFAITENFVVIPDQQMVFKLSEMIRGGSPVIYVKEKMARFGVLSKQDLTGSDINWVDVPDCFCFHLWNAWEERTEEGDPVIVVIGSCMSPPDTIFSESGEPTRVELSEIRLNMRTKESNRKVIVTGVNLEAGHINRSYVGRKSQFVYIAIADPWPKCSGIAKVDIQNGTVSEFNYGPSRFGGEPCFVPEGEGEEDKGYVMGFVRDEEKDESEFVVVDATDMKQVAAVRLPERVPYGFHGTFVSENQLKEQVF

SEQ ID NO: 51724 - protein, 289 aa, Arabidopsis thaliana
  misc_feature: Useful for making plants with altered cell wall content and/or composition
MLDFLRETGSRLMINVYPFFAYEGNSDVIPLDYALLRENPGMVDSGNGLRYFNLFDAQIDAVFAAMSALKYDDIEIIVTETGWPSKGDENEVGATLANAASYNGNLIRRILTRGGTPLRPKADLTVYLFALFNENKKLGPTSERNYGLFFPDEKKVYDIPFTTEGLKHYRDGGHTPVTGGDQVTKPPMSGGVSKSLNGYTWCVANGDAGEERLQGGLDYACGEGGADCRPIQPGANCYSPDTLEAHASFAFNSYYQKKGRAGGSCYFGGAAYVVSQPPKYGRCEFPTGY

SEQ ID NO: 51725 - protein, 125 aa, Arabidopsis thaliana
  misc_feature: Useful for making plants with altered alkaloid content
MANLMMRLPISLRSFSVSASSSNGSPPVIGGSSGGVGPMIVELPLEKIRRPLMRTRSNDQNKVKELMDSIRQIGLQVPIDVIEVDGTYYGFSGCHRYEAHQKLGLPTIRCKIRKGTKETLRHHLR

SEQ ID NO: 51726 - protein, 334 aa, Arabidopsis thaliana
  misc_feature: Useful for making plants with altered cell wall content and/or composition
MAPEMNNKLSYGEKKRAYVTFLAGTGDYVKGVVGLAKGLRKTKSKYPLVVAVLPDVPADHRRQLLDQGCVIKEIQPVYPPDNQTQFAMAYYVLNYSKLRIWKFVEYSKLIYLDGDIQVFENIDHLFDLPDGNFYAVKDCFCEKTWSHTPQYKIGYCQQCPDKVTWPESELGPKPPLYFNAGMFVYEPSLPTYYNLLETLKVVPPTPFAEQDFLNMYFKDIYKPIPPVYNLVLAMLWRHPENIELNEAKVVHYCAAGAKPWRFTGQEGNMEREDIKMLVEKWWDIYNDESLDYKNFNVHCGQKEDVHRKPKTLPQFFTDLSEADVLQCAKAPSAA

SEQ ID NO: 51727 - protein, 225 aa, Arabidopsis thaliana
  misc_feature: Useful for making plants with modulated nitrogen use efficiency
MASGIVEGGGSLSDVYSSAKRILLKARDGIERLERFESSSMDSPDLASSVKRDITEVRSLCSNMDTLWRSIPVKSQRDLWRRKTEQVGEEAEYLNLSLEKYMSRNQRKMLEAKERADLLGRASGEGAHILQIFDEEAQAMSSVKNSKRMLEESFSSGVAILSKYAEQRDRLKSAQRKALDVLNTVGLSNSVLRLIERRNRVDTWIKYAGMIATLVILYLFIRWTR

SEQ ID NO: 51728 - protein, 131 aa, Arabidopsis thaliana; identical to SEQ ID NO: 9301
  misc_feature: Useful for making plants with modulated light quality response
  misc_feature (26)..(26): Xaa is any aa, unknown, or other
  misc_feature (45)..(45): Xaa is any aa, unknown, or other
  misc_feature (54)..(54): Xaa is any aa, unknown, or other
  misc_feature (80)..(80): Xaa is any aa, unknown, or other

SEQ ID NO: 51729 - protein, 92 aa, Triticum aestivum; identical to SEQ ID NO: 9678
  misc_feature: Useful for making plants with modulated nitrogen use efficiency
  misc_feature: Useful for making plants with modulated seedling growth

SEQ ID NO: 51730 - protein, 125 aa, Arabidopsis thaliana; identical to SEQ ID NO: 9634
  misc_feature: Useful for making plants with modulated biomass

SEQ ID NO: 51731 - protein, 85 aa, Zea mays; identical to SEQ ID NO: 9692
  misc_feature: Useful for making plants with modulated nitrogen use efficiency

SEQ ID NO: 51732 - protein, 253 aa, Brassica napus
  misc_feature: Useful for making plants with altered alkaloid content
  misc_feature (155)..(155): Xaa is any aa, unknown, or other
  misc_feature (192)..(192): Xaa is any aa, unknown, or other
  misc_feature (193)..(193): Xaa is any aa, unknown, or other
  misc_feature (197)..(197): Xaa is any aa, unknown, or other
METLNPLSHVPISDHRFVGQDMMSLQSPSSIWTKEENKMFERALAIYPEDSPDRWFKIASMIPGKTVFDVMKQYSKLEEDVFDIEEGRVPIPGYPSPLGLAQDTYRKRPNGARGSDHDRKKGVPWTEEEHRRFLLGLLKYGKGDWRNISRNFVVXKTPTQVASHAQKYYQRQLSGAKDKRRPSIHDITTGNXXNANXNRSFSDHRDILPDLVFIEKDNAEGLMCMSPNLFSPSSAPFDDAFNFAGVNAFSAGA

SEQ ID NO: 51733 - protein, 310 aa, Arabidopsis thaliana
  misc_feature: Useful for making plants with altered cell wall content and/or composition
MRSITALFFLFCFLAPSALAQLRTGFYSRSCPRAESIVASVVANRFRSDKSITAAFLRMQFHDCFVRGCDASLLIDPRPGRPSEKSTGPNASVRGYEIIDEAKRQLEAACPRTVSCADIVTLATRDSVALAGGPRFSVPTGRRDGLRSNPNDVNLPGPTIPVSASIQLFAAQGMNTNDMVTLIGGGHSVGVAHCSLFQDRLSDRAMEPSLKSSLRRKCSSPNDPTTFLDQKTSFTVDNAIYGEIRRQRGILRIDQNLGLDRSTSGIVSGYASSNTLFRKRFAEALVKMGTIKVLTGRSGEIRRNCRVFNN

SEQ ID NO: 51734 - protein, 548 aa, Arabidopsis thaliana
  misc_feature: Useful for making plants with modulated cold sensitivity
MGRSKLASRPAEEDLNPGKSKRKKISLGPENAAASISTGIEAGNERKPGLYCCNYCDKDLSGLVRFKCAVCMDFDLCVECFSVGVELNRHKNSHPYRVMDNLSFSLVTSDWNADEEILLLEAIATYGFGNWKEVADHVGSKTTTECIKHFNSAYMQSPCFPLPDLSHTIGKSKDELLAMSKDSAVKTEIPAFVRLSPKEELPVSAEIKHEASGKVNEIDPPLSALAGVKKKGNVPQAKDIIKLEAAKQQSDRSVGEKKLRLPGEKVPLVTELYGYNLKREEFEIEHDNDAEQLLADMEFKDSDTDAEREQKLQVLRIYSKRLDERKRRKEFVLERNLLYPDQYEMSLSAEERKIYKSCKVFARFQSKEEHKELIKKVIEEHQILRRIEDLQEARTAGCRTTSDANRFIEEKRKKEAEESMLLRLNHGAPGSIAGKTLKSPRGLPRNLHPFGSDSLPKVTPPRIYSGLDTWDVDGLLGADLLSETEKKMCNETRILPVHYLKMLDILTREIKKGQIKKKSDAYSFFKVEPSKVDRVYDMLVHKGIGDST

SEQ ID NO: 51735 - protein, 667 aa, Panicum virgatum; identical to SEQ ID NO: 6788
  misc_feature: Useful for making plants with altered carbohydrate content

SEQ ID NO: 51736 - protein, 253 aa, Arabidopsis thaliana; identical to SEQ ID NO: 9746
  misc_feature: Useful for biocontainment applications
  misc_feature: Useful for making plants with modulated biomass

SEQ ID NO: 51737 - protein, 176 aa, Arabidopsis thaliana
  misc_feature: Useful for biocontainment applications
  misc_feature: Useful for making plants with altered terpenoid content
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTVTSSSSSSSVITSTTQEPATTEASQIKVSNVTSGHGSFASLLGLGSGNGGLDYGFGYGYGLEDMSIGYLGDSSVGEIPVVDGCG

SEQ ID NO: 51738 - protein, 741 aa, Arabidopsis thaliana
  misc_feature: Useful for making plants with altered cell wall content and/or composition
MNRVTTESIASTAILVVMVFLFSWRSIEAANVSYDHRSLTIGNRRQLIISAAIHYPRSVPAMWPSLVQTAKEGGCNAIESYVFWNGHEPSPGKYYFGGRYNIVKFIKIVQQAGMHMILRIGPFVAAEWNYGGVPVWLHYVPGTVFRADNEPWKHYMESFTTYIVNLLKQEKLFAPQGGPIILSQVENEYGYYEKDYGEGGKRYAQWSASMAVSQNIGVPWMMCQQWDAPPTVISTCNGFYCDQFTPNTPDKPKIWTENWPGWFKTFGGRDPHRPAEDVAYSVARFFGKGGSVHNYYMYHGGTNFGRTSGGPFITTSYDYEAPIDEYGLPRLPKWGHLKDLHKAIMLSENLLISGEHQNFTLGHSLEADVYTDSSGTCAAFLSNLDDKNDKAVMFRNTSYHLPAWSVSILPDCKTEVFNTAKVTSKSSKVEMLPEDLKSSSGLKWEVFSEKPGIWGAADFVKNELVDHINTTKDTTDYLWYTTSITVSENEAFLKKGSSPVLFIESKGHTLHVFINKEYLGTATGNGTHVPFKLKKPVALKAGENNIDLLSMTVGLANAGSFYEWVGAGLTSVSIKGFNKGTLNLTNSKWSYKLGVEGEHLELFKPGNSGAVKWTVTTKPPKKQPLTWYKVVIEPPSGSEPVGLDMISMGKGMAWLNGEEIGRYWPRIARKNSPNDECVKECDYRGKFMPDKCLTGCGEPSQRWYHVPRSWFKSSGNELVIFEEKGGNPMKIKLSKRKVSVV

SEQ ID NO: 51739 - protein, 391 aa, Arabidopsis thaliana
  misc_feature: Useful for making plants with altered cell wall content and/or composition
MGRLKQCWSSLLVLAVLVIGTGAVPITYLQSAVAKGAVCLDGSAPAYHFDKGFGSGVNNWIVHMEGGGWCTDVASCNERKGTMKGSSKFMNKDFGFSGILGGKQSTNPDFYNWNRIKVRYCDGSSFTGNVEAVNPANKLFFRGARVWRAVVDDLMAKGMKNAQNAILSGCSAGALAAILHCDTFRAILPRTASVKCVSDAGYFIHGKDITGGSYIQSYYSKVVALHGSAKSLPVSCTSKMKPELCFFPQYVVPSMRTPLFVINAAFDSWQIKNVLAPTAVDKGKEWKNCKLDLKKCSAAQLKTVQGFRDQMMRALSPVHSTPSRGLFLDSCHAHCQGGSAASWSGDKGPQVANTRIAKAVGNWFYGRSAFQKIDCPSPTCNPTCPAISTED

SEQ ID NO: 51740 - protein, 619 aa, Arabidopsis thaliana
  misc_feature: Useful for making plants with altered cell wall content and/or composition
MKGGGGGGGGGGGGKRRWKVLVIGVLVLVILSMLVPLAFLLGLHNGFHSPGFVTVQPASSFESFTRINATKHTQRDVSERVDEVLQKINPVLPKKSDINVGSRDVNATSGTDSKKRGLPVSPTVVANPSPANKTKSEASYTGVQRKIVSGDETWRTCEVKYGSYCLWREENKEPMKDAKVKQMKDQLFVARAYYPSIAKMPSQSKLTRDMKQNIQEFERILSESSQDADLPPQVDKKLQKMEAVIAKAKSFPVDCNNVDKKLRQILDLTEDEASFHMKQSVFLYQLAVQTMPKSLHCLSMRLTVEHFKSDSLEDPISEKFSDPSLLHFVIISDNILASSVVINSTVVHARDSKNFVFHVLTDEQNYFAMKQWFIRNPCKQSTVQVLNIEKLELDDSDMKLSLSAEFRVSFPSGDLLASQQNRTHYLSLFSQSHYLLPKLFDKLEKVVILDDDVVVQRDLSPLWDLDMEGKVNGAVKSCTVRLGQLRSLKRGNFDTNACLWMSGLNVVDLARWRALGVSETYQKYYKEMSSGDESSEAIALQASLLTFQDQVYALDDKWALSGLGYDYYINAQAIKNAAILHYNGNMKPWLELGIPNYKNYWRRHLSREDRFLSDCNVNP

SEQ ID NO: 51741 - protein, 562 aa, Panicum virgatum; identical to SEQ ID NO: 5082
  misc_feature: Useful for making plants with altered carbohydrate content

SEQ ID NO: 51742 - protein, 482 aa, Panicum virgatum; identical to SEQ ID NO: 6342
  misc_feature: Useful for making plants with altered carbohydrate content

SEQ ID NO: 51743 - protein, 738 aa, Arabidopsis thaliana
  misc_feature: Useful for making plants with modulated biomass
  misc_feature: Useful for making plants with modulated biotic stress sensitivity
  misc_feature: Useful for making plants with modulated light response
  misc_feature: Useful for making plants with modulated root development
  misc_feature: Useful for making plants with modulated salt sensitivity
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGVLLKPVSLDNIRDVLSDLLEPRVLYEGM

SEQ ID NO: 51744 - protein, 687 aa, Panicum virgatum; identical to SEQ ID NO: 4590
  misc_feature: Useful for making plants with altered carbohydrate content

SEQ ID NO: 51745 - protein, 361 aa, Arabidopsis thaliana; identical to SEQ ID NO: 9751
  misc_feature: Useful for making plants with modulated biomass

SEQ ID NO: 51746 - protein, 656 aa, Panicum virgatum; identical to SEQ ID NO: 972
  misc_feature: Useful for making plants with altered carbohydrate content

SEQ ID NO: 51747 - protein, 534 aa, Panicum virgatum; identical to SEQ ID NO: 3722
  misc_feature: Useful for making plants with altered carbohydrate content

SEQ ID NO: 51748 - protein, 558 aa, Arabidopsis thaliana; identical to SEQ ID NO: 9612
  misc_feature: Useful for making plants with altered alkaloid content

SEQ ID NO: 51749 - protein, 509 aa, Arabidopsis thaliana
  misc_feature: Useful for making plants with altered cell wall content and/or composition
MGDFNLALVIVAIVVCVIVFISSIYLLVNYQHPDDANQAYFPKFVVVFGLSIAMISILMLPADVANRHACRHSIYNGACNLTLPMKDLWLAVYIVDAVLVFFIIPFAMFFYEGDQDKALGKRIKSALIWVVTTAVVCALVLGILYGVIGKVDFSVRHLSSATTTFPTSWQFSNNQPCIGNTARQCSAYTANAASEKTWSMRTTFPEYVVALATIVGSVLFTIFGGVGIACLPLGLITAFIRRPKAVITRSQYIKEATELGKKARDLKKAADALHQEERSGAKGRKWRKNVKAVEKELLQLEEDVNLLEEMYPQGEQAETAWAFTVLGYLAKFVLGILGLIVSVAWIAHIIIYLLVDPPLSPFLNEVFIKLDDVWGLLGTAAFAFFCFYLLLAVIAGAMMLGLKLVFITIHPMKWGATLMNSFLFNVGLILLCSISVIQFCATAFGYYAQATAAQEIFGHTLQSLRGIKYLYKYNVFQIGFVVLAGLTFLYYIAFGWRRKKPSGRFQLST

SEQ ID NO: 51750 - protein, 489 aa, Panicum virgatum; identical to SEQ ID NO: 3274
  misc_feature: Useful for making plants with altered carbohydrate content

SEQ ID NO: 51751 - protein, 477 aa, Arabidopsis thaliana
  misc_feature: Useful for making plants with altered cell wall content and/or composition
MGWGSVLLLLAVALLCQRASSIGANWGTQASHPLPPDIVVRMLRENGIQKVKLFDAEYDTLRALGKSGIEVMVGIPNEMLATLASSLKAAEKWVAKNVSTHISTDNVNIRYVAVGNEPFLSTYNGSYLSTTFPALRNIQIAIIKAGLQNQVKVTCPLNADVYDSSTTFPSGGDFRANIRDLMITIVKFLSENGGPFTVNIYPYISLYTNPDFPVDYAFFDGNAQPLNDGGTFYYNMFDANYDTLVHALEKNGFGNMPIIIGEIGWPTDGDSNANLDYAKKFNQGFMAHISGGKGTPRRPGPIDAYLFSLIDEDAKSVQPGYFERHWGIFTFDGLPKYALNLGTTNTGALIQAKGVRYLERKWCVMKPNVRLDDPQVAPAVSYACSLGDCTSLGVGTSCANLDGKQNISYAFNSYYQIQDQLDTACKFPNISEVTKTDPSTGTCRFPIMIEPYYGGAAREHGFFFPLLMVAAIAVSIF

SEQ ID NO: 51752 - protein, 114 aa, Arabidopsis thaliana
  misc_feature: Useful for making plants with modulated biomass
  misc_feature: Useful for making plants with modulated flowering time
MCGIFAYLNFHANKERRYILDVLFNGLRRLEYRGYDSAGIAIDNSSPSSSPLVFRQAGNIESLVNSVNEEITNTDLNLDEVFYFHAGIAHTRWATHGEPAPRNSHPQSSGPGDD

SEQ ID NO: 51753 - protein, 675 aa, Arabidopsis thaliana
  misc_feature: Useful for making plants with modulated light quality sensitivity
MEEISTDPVVPAVKPDPRTSSVGEGANRHENDDGGSGGSEIGAPDLDKDLLCPICMQIIKDAFLTACGHSFCYMCIITHLRNKSDCPCCSQHLTNNQLYPNFLLDKLLKKTSARHVSKTASPLDQFREALQRGCDVSIKEVDNLLTLLAERKRKMEQEEAERNMQILLDFLHCLRKQKVDELNEVQTDLQYIKEDINAVERHRIDLYRARDRYSVKLRMLGDDPSTRNAWPHEKNQIGFNSNSLSIRGGNFVGNYQNKKVEGKAQGSSHGLPKKDALSGSDSQSLNQSTVSMARKKRIHAQFNDLQECYLQKRRQLADQPNSKQENDKSVVRREGYSNGLADFQSVLTTFTRYSRLRVIAEIRHGDIFHSANIVSSIEFDRDDELFATAGVSRCIKVFDFSSVVNEPADMQCPIVEMSTRSKLSCLSWNKHEKNHIASSDYEGIVTVWDVTTRQSLMEYEEHEKRAWSVDFSRTEPSMLVSGSDDCKVKVWCTRQEASVINIDMKANICCVKYNPGSSNYIAVGSADHHIHYYDLRNISQPLHVFSGHKKAVSYVKFLSNNELASASTDSTLRLWDVKDNLPVRTFRGHTNEKNFVGLTVNSEYLACGSETNEVYVYHKEITRPVTSHRFGSPDMDDAEEEAGSYFISAVCWKSDSPTMLTANSQGTIKVLVLAA

SEQ ID NO: 51754 - protein, 430 aa, Arabidopsis thaliana
  misc_feature: Useful for making plants with altered cell wall content and/or composition
MKQMSHLDDIPSTPGKFKPYFHRTRWQSSVAKLAFWSLVFVGLIFIFFYRSPVSSNPADPSRRSLRTYSWGGPAWEKRVRSSARLRTRRGFSVLVTGAAGFVGTHVSAALKRRGDGVLGLDNFNDYYDPSLKRARQALLERSGVFVVEGDINDAALLKKLFEVVPFTHVMHLAAQAGVRYAMENPSSYVHSNIAGFVNLLEVCKSANPQPAIVWASSSSVYGLNTKVPFSEKDRTDQPASLYAATKKAGEEIAHTYNHIYGLSLTGLRFFTVYGPWGRPDMAYFFFTRDILKGKAISIFEGVNHGTVARDFTYIDDIVKGCLGALDTAEKSTGSGGKKRGAAQLRVFNLGNTSPVPVTDLVTILERLLKVKAKRNIMKLPRNGDVQFTHANISSAQRELGYKPTTDLQTGLKKFARWYLGYYNGGKKAAS

SEQ ID NO: 51755 - protein, 623 aa, Arabidopsis thaliana
  misc_feature: Useful for making plants with altered cell wall content and/or composition
MMRGRSDGGLKKRLIASVCVVALFVCFLFMYYGSSSQGASALEYGRSLRKLGSSYLSGDDDNGDTKQDDSVANAEDSLVVAKSFPVCDDRHSEIIPCLDRNFIYQMRLKLDLSLMEHYERHCPPPERRFNCLIPPPSGYKVPIKWPKSRDEVWKANIPHTHLAKEKSDQNWMVEKGEKISFPGGGTHFHYGADKYIASIANMLNFSNDVLNDEGRLRTVLDVGCGVASFGAYLLASDIMTMSLAPNDVHQNQIQFALERGIPAYLGVLGTKRLPYPSRSFEFAHCSRCRIDWLQRDGLLLLELDRVLRPGGYFAYSSPEAYAQDEENLKIWKEMSALVERMCWRIAVKRNQTVVWQKPLSNDCYLEREPGTQPPLCRSDADPDAVAGVSMEACITPYSKHDHKTKGSGLAPWPARLTSSPPRLADFGYSTDMFEKDTELWKQQVDSYWNLMSSKVKSNTVRNIMDMKAHMGSFAAALKDKDVWVMNVVSPDGPNTLKLIYDRGLIGTNHNWCEAFSTYPRTYDLLHAWSIFSDIKSKGCSAEDLLIEMDRILRPTGFVIIRDKQSVVESIKKYLQALHWETVASEKVNTSSELDQDSEDGENNVVFIVQKKLWLTSESLRDSE

SEQ ID NO: 51756 - protein, 297 aa, Arabidopsis thaliana; identical to SEQ ID NO: 9500
  misc_feature: Useful for making plants with modulated flowering time

SEQ ID NO: 51757 - protein, 722 aa, Arabidopsis thaliana
  misc_feature: Useful for making plants with altered cell wall content and/or composition
MEPQRKHSTALHTCHPCRRTIPYRIYAVFHTCGIIALMYHHVHSIVNANNTLITCLLLLSDIVLAFMWATTTSLRLNPIHRTEYPEKYAAKPEDFPKLDVFICTADPYKEPPMMVVNTALSVMAYEYPSHKISVYVSDDGGSSLTLFALMEAAKFSKHWLPFCKNNNVQDRSPEVYFSSKSHSSSDEAENLKMMYEDMKSRVEHVVESGKVETAFIACDQFSCVFDLWTDKFTRHDHPTIIMVLQHNETEMMPNLIYVSREKSKVSPHHFKAGALNTLLRVSAVMTNSPIILTLDCDMYSNNPTTPLHALCYLSDPKINFDLGFVQFPQKFQGVNKNDIYASELKRPFDINTVGFDGLMGPVHMGTGCFFNRRAFYGPPTTLILPEIETFGPNRIADKPIKAQDILALAHDVAGCNYECNTNWGSKIGFRYGSLVEDYFTGFMLHCEGWRSIFCSPTKAAFYGDSPKCLTDVIGQQIRWSVGLLEVAFSRYNPLTYGIKPLSLLMSLGYCHYAFWPFWCIPLVVYGILPQVALIHGVSVFPKASDPWFWLYIILFLGGYAQDLSDFLLEGGTYRKWWNDQRMWMVRGLSSFFFGFTEFTLKTLNLSTQGYNVTSKSNDDNEQMKRYEQEIFDFGPSSSMFLPITTVAIMNLLAFMRGLYGIFTWGEGPVLELMLASFAVVNCLPIYEAMVLRIDDGKLPKRICFLAGLLSFVLTGSGYFFLK

SEQ ID NO: 51758 - protein, 506 aa, Arabidopsis thaliana
  misc_feature: Useful for making plants with altered cell wall content and/or composition
MKHFSLLFIFLVILLATSYSDAFTRNSFPKDFLFGAATSAYQWEGAVAEDGRTPSVWDTFSNSYDTGNGDVTSDGYHKYKEDVKLMATMGLESFRFSISWSRLIPNGRGLINPKGLLFYNNLIKDLKSHGIEPHVTLYHYDLPQSLEDEYGGWINRKIIEDFTAYADVCFREFGEDVKLWTTINEATIFAIGSYDQGTAPPGHCSPNKFVNCSTGNSSTEPYIAGHNILLAHASASKLYKLKYKSKQKGSIGLSIFAFGLSPYTNSKDDEIATQRAKTFLYGWMLKPLVFGDYPDEMKKTVGSRLPVFSEEESEQVKGSSDFIGIIHYTTFYVTNHQPSASLFPSMGEGFFKDMGVYIIPTGNSSFLVWEATPWGLEGILEYIKQSYNNPPVYILENGMPMVRDSTLQDTQRIEYIQAYIDAVLNAMKNGSDTRGYFVWSMVDVYEILSGYTTSFGMYHVNFSDPGRKRTPKLSASWYTGFLNGTIDVASQDTIQLWSNFSVSSSL

SEQ ID NO: 51759 - protein, 210 aa, Arabidopsis thaliana; identical to SEQ ID NO: 9287
  misc_feature: Useful for making plants with altered alkaloid content

SEQ ID NO: 51760 - protein, 573 aa, Panicum virgatum; identical to SEQ ID NO: 5024
  misc_feature: Useful for making plants with altered carbohydrate content

SEQ ID NO: 51761 - protein, 376 aa, Arabidopsis thaliana
  misc_feature: Useful for making plants with altered cell wall content and/or composition
MVDQNKAFGWAANDESGVLSPFHFSRRENGENDVTVKILFCGVCHSDLHTIKNHWGFSRYPIIPGHEIVGIATKVGKNVTKFKEGDRVGVGVIIGSCQSCESCNQDLENYCPKVVFTYNSRSSDGTSRNQGGYSDVIVVDHRFVLSIPDGLPSDSGAPLLCAGITVYSPMKYYGMTKESGKRLGVNGLGGLGHIAVKIGKAFGLRVTVISRSSEKEREAIDRLGADSFLVTTDSQKMKEAVGTMDFIIDTVSAEHALLPLFSLLKVNGKLVALGLPEKPLDLPIFSLVLGRKMVGGSQIGGMKETQEMLEFCAKHKIVSDIELIKMSDINSAMDRLAKSDVRYRFVIDVANSLLPESSAEILTEQVDHGVSITSRF

SEQ ID NO: 51762 - protein, 365 aa, Arabidopsis thaliana
  misc_feature: Useful for making plants with altered lignin content
MGSVEAGEKKALGWAARDPSGVLSPYSYTLRSTGADDVYIKVICCGICHTDIHQIKNDLGMSNYPMVPGHEVVGEVLEVGSDVSKFTVGDVVGVGVVVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAIEHLGADDYVVSSDPAEMQRLADSLDYIIDTVPVFHPLDPYLACLKLDGKLILMGVINTPLQFVTPLVILGRKVISGSFIGSIKETEEVLAFCKEKGLTSTIETVKIDELNIAFERLRKNDVRYRFVVDVAGSNLVEEAATTTN

SEQ ID NO: 51763 - protein, 483 aa, Panicum virgatum; identical to SEQ ID NO: 1666
  misc_feature: Useful for making plants with altered carbohydrate content

SEQ ID NO: 51764 - protein, 642 aa, Panicum virgatum; identical to SEQ ID NO: 6742
  misc_feature: Useful for making plants with altered carbohydrate content

SEQ ID NO: 51765 - protein, 434 aa, Zea mays; identical to SEQ ID NO: 9280
  misc_feature: Useful for making plants with altered protein content

SEQ ID NO: 51766 - protein, 720 aa, Arabidopsis thaliana
  misc_feature: Useful for making plants with altered cell wall content and/or composition
MIKIADFTLFFFIFVFSPSLPLAQSQLPDLDPQDKASLLIFRVSIHDLNRSLSTWYGSSCSNWTGLACQNPTGKVLSLTLSGLNLSSQIHPSLCKLSSLQSLDLSHNNFSGNIPSCFGSLRNLRTLNLSRNRFVGSIPATFVSLKELREVVLSENRDLGGVVPHWFGNFSMNLERVDFSFCSFVGELPESLLYLKSLKYLNLESNNMTGTLRDFQQPLVVLNLASNQFSGTLPCFYASRPSLSILNIAENSLVGGLPSCLGSLKELSHLNLSFNGFNYEISPRLMFSEKLVMLDLSHNGFSGRLPSRISETTEKLGLVLLDLSHNSFSGDIPLRITELKSLQALRLSHNLLTGDIPARIGNLTYLQVIDLSHNALTGSIPLNIVGCFQLLALMISNNNLSGEIQPELDALDSLKILDISNNHISGEIPLTLAGLKSLEIVDISSNNLSGNLNEAITKWSNLKYLSLARNKFSGTLPSWLFKFDKIQMIDYSSNRFSWFIPDDNLNSTRFKDFQTGGGEGFAEPPGKVEIKISAAVVAKDELSFSYNLLSMVGIDLSDNLLHGEIPEALFRQKNIEYLNLSYNFLEGQLPRLEKLPRLKALDLSHNSLSGQVIGNISAPPGLTLLNLSHNCFSGIITEKEGLGKFPGALAGNPELCVETPGSKCDPANIDASQEEIYQNELVEGPISIWIFCLSAFISFDFGVLGIFCSARARSYILQTKA

SEQ ID NO: 51767 - protein, 482 aa, Arabidopsis thaliana
  misc_feature: Useful for making plants with modulated heat sensitivity
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSR

SEQ ID NO: 51768 - protein, 533 aa, Arabidopsis thaliana
  misc_feature: Useful for making plants with altered cell wall content and/or composition
MQLHISPSMRSITISSSNEFIDLMKIKVAARHISYRTLFHTILILAFLLPFVFILTAVVTLEGVNKCSSFDCFGRRLGPRLLGRIDDSEQRLVRDFYKILNEVSTQEIPDGLKLPESFSQLVSDMKNNHYDAKTFALVFRAMVEKFERDLRESKFAELMNKHFAASSIPKGIHCLSLRLTDEYSSNAHARRQLPSPELLPVLSDNAYHHFVLATDNILAASVVVSSAVQSSSKPEKIVFHVITDKKTYAGMHSWFALNSVAPAIVEVKSVHQFDWLTRENVPVLEAVESHNSIRNYYHGNHIAGANLSETTPRTFASKLQSRSPKYISLLNHLRIYLPELFPNLDKVVFLDDDIVIQKDLSPLWDIDLNGKVNGAVETCRGEDVWVMSKRLRNYFNFSHPLIAKHLDPEECAWAYGMNIFDLRTWRKTNIRETYHSWLKENLKSNLTMWKLGTLPPALIAFKGHVQPIDSSWHMLGLGYQSKTNLENAKKAAVIHYNGQSKPWLEIGFEHLRPFWTKYVNYSNDFIKNCHILE

SEQ ID NO: 51769 - protein, 720 aa, Panicum virgatum; identical to SEQ ID NO: 4634
  misc_feature: Useful for making plants with altered carbohydrate content

SEQ ID NO: 51770 - protein, 475 aa, Zea mays; identical to SEQ ID NO: 9490
  misc_feature: Useful for making plants with altered terpenoid content

SEQ ID NO: 51771 - protein, 733 aa, Arabidopsis thaliana
  misc_feature: Useful for making plants with modulated drought sensitivity
MEDPLIGRDSLGGGGTDRVRRSEAITHGTPFQKAAALVDLAEDGIGLPVEILDQSSFGESARYYFIFTRLDLIWSLNYFALLFLNFFEQPLWCEKNPKPSCKDRDYYYLGELPYLTNAESIIYEVITLAILLVHTFFPISYEGSRIFWTSRLNLVKVACVVILFVDVLVDFLYLSPLAFDFLPFRIAPYVRVIIFILSIRELRDTLVLLSGMLGTYLNILALWMLFLLFASWIAFVMFEDTQQGLTVFTSYGATLYQMFILFTTSNNPDVWIPAYKSSRWSSVFFVLYVLIGVYFVTNLILAVVYDSFKEQLAKQVSGMDQMKRRMLEKAFGLIDSDKNGEIDKNQCIKLFEQLTNYRTLPKISKEEFGLIFDELDDTRDFKINKDEFADLCQAIALRFQKEEVPSLFEHFPQIYHSALSQQLRAFVRSPNFGYAISFILIINFIAVVVETTLDIEESSAQKPWQVAEFVFGWIYVLEMALKIYTYGFENYWREGANRFDFLVTWVIVIGETATFITPDENTFFSNGEWIRYLLLARMLRLIRLLMNVQRYRAFIATFITLIPSLMPYLGTIFCVLCIYCSIGVQVFGGLVNAGNKKLFETELAEDDYLLFNFNDYPNGMVTLFNLLVMGNWQVWMESYKDLTGTWWSITYFVSFYVITILLLLNLVVAFVLEAFFTELDLEEEEKCQGQDSQEKRNRRRSAGSKSRSQRVDTLLHHMLGDELSKPECSTSDT

SEQ ID NO: 51772 - protein, 787 aa, Arabidopsis thaliana
  misc_feature: Useful for making plants with modulated water use efficiency
MASFIDLFAGDITTQLLKLLALVANTVYSCKGIAERLITMIRDVQPTIREIQYSGAELSNHHQTQLGVFYEILEKARKLCEKVLRCNRWNLKHVYHANKMKDLEKQISRFLNSQILLFVLAEVCHLRVNGDRIERNMDRLLTERNDSLSFPETMMEIETVSDPEIQTVLELGKKKVKEMMFKFTDTHLFGISGMSGSGKTTLAIELSKDDDVRGLFKNKVLFLTVSRSPNFENLESCIREFLYDGVHQRKLVILDDVWTRESLDRLMSKIRGSTTLVVSRSKLADPRTTYNVELLKKDEAMSLLCLCAFEQKSPPSPFNKYLVKQVVDECKGLPLSLKVLGASLKNKPERYWEGVVKRLLRGEAADETHESRVFAHMEESLENLDPKIRDCFLDMGAFPEDKKIPLDLLTSVWVERHDIDEETAFSFVLRLADKNLLTIVNNPRFGDVHIGYYDVFVTQHDVLRDLALHMSNRVDVNRRERLLMPKTEPVLPREWEKNKDEPFDAKIVSLHTGEMDEMNWFDMDLPKAEVLILNFSSDNYVLPPFIGKMSRLRVLVIINNGMSPARLHGFSIFANLAKLRSLWLKRVHVPELTSCTIPLKNLHKIHLIFCKVKNSFVQTSFDISKIFPSLSDLTIDHCDDLLELKSIFGITSLNSLSITNCPRILELPKNLSNVQSLERLRLYACPELISLPVEVCELPCLKYVDISQCVSLVSLPEKFGKLGSLEKIDMRECSLLGLPSSVAALVSLRHVICDEETSSMWEMVKKVVPELCIEVAKKCFTVDWLDD

SEQ ID NO: 51773 - protein, 1584 aa, Arabidopsis thaliana
  misc_feature: Useful for making plants with modulated drought sensitivity
MASFIDLFAGDITTQLLKLLALVANTVYSCKGIAERLITMIRDVQPTIREIQYSGAELSNHHQTQLGVFYEILEKARKLCEKVLRCNRWNLKHVYHANKMKDLEKQISRFLNSQILLFVLAEVCHLRVNGDRIERNMDRLLTERNDSLSFPETMMEIETVSDPEIQTVLELGKKKVKEMMFKFTDTHLFGISGMSGSGKTTLAIELSKDDDVRGLFKNKVLFLTVSRSPNFENLESCIREFLYDGVHQRKLVILDDVWTRESLDRLMSKIRGSTTLVVSRSKLADPRTTYNVELLKKDEAMSLLCLCAFEQKSPPSPFNKYLVKQVVDECKGLPLSLKVLGASLKNKPERYWEGVVKRLLRGEAADETHESRVFAHMEESLENLDPKIRDCFLDMGAFPEDKKIPLDLLTSVWVERHDIDEETAFSFVLRLADKNLLTIVNNPRFGDVHIGYYDVFVTQHDVLRDLALHMSNRVDVNRRERLLMPKTEPVLPREWEKNKDEPFDAKIVSLHTGKTSLTLNEFGEMDEMNWFDMDLPKAEVLILNFSSDNYVLPPFIGKMSRLRVLVIINNGMSPARLHGFSIFANLAKLRSLWLKRVHVPELTSCTIPLKNLHKIHLIFCKVKNSFVQTSFDISKIFPSLSDLTIDHCDDLLELKSIFGITSLNSLSITNCPRILELPKNLSNVQSLERLRLYACPELISLPVEVCELPCLKYVDISQCVSLVSLPEKFGKLGSLEKIDMRECSLLGLPSSVAALVSLRHVICDEETSSMWEMVKKVVPELCIEVAKKCFTVDWLDDMASFIDLFAGDITTQLLKLLALVANTVYSCKGIAERLITMIRDVQPTIREIQYSGAELSNHHQTQLGVFYEILEKARKLCEKVLRCNRWNLKHVYHANKMKDLEKQISRFLNSQILLFVLAEVCHLRVNGDRIERNMDRLLTERNDSLSFPETMMEIETVSDPEIQTVLELGKKKVKEMMFKFTDTHLFGISGMSGSGKTTLAIELSKDDDVRGLFKNKVLFLTVSRSPNFENLESCIREFLYDGVHQRKLVILDDVWTRESLDRLMSKIRGSTTLVVSRSKLADPRTTYNVELLKKDEAMSLLCLCAFEQKSPPSPFNKYLVKQVVDECKGLPLSLKVLGASLKNKPERYWEGVVKRLLRGEAADETHESRVFAHMEESLENLDPKIRDCFLDMGAFPEDKKIPLDLLTSVWVERHDIDEETAFSFVLRLADKNLLTIVNNPRFGDVHIGYYDVFVTQHDVLRDLALHMSNRVDVNRRERLLMPKTEPVLPREWEKNKDEPFDAKIVSLHTGEMDEMNWFDMDLPKAEVLILNFSSDNYVLPPFIGKMSRLRVLVIINNGMSPARLHGFSIFANLAKLRSLWLKRVHVPELTSCTIPLKNLHKIHLIFCKVKNSFVQTSFDISKIFPSLSDLTIDHCDDLLELKSIFGITSLNSLSITNCPRILELPKNLSNVQSLERLRLYACPELISLPVEVCELPCLKYVDISQCVSLVSLPEKFGKLGSLEKIDMRECSLLGLPSSVAALVSLRHVICDEETSSMWEMVKKVVPELCIEVAKKCFTVDWLDD

SEQ ID NO: 51774 - protein, 359 aa, Arabidopsis thaliana
  misc_feature: Useful for making plants with altered cell wall content and/or composition
MGKVLQKEAFGLAAKDNSGVLSPFSFTRRETGEKDVRFKVLFCGICHSDLHMVKNEWGMSTYPLVPGHEIVGVVTEVGAKVTKFKTGEKVGVGCLVSSCGSCDSCTEGMENYCPKSIQTYGFPYYDNTITYGGYSDHMVCEEGFVIRIPDNLPLDAAAPLLCAGITVYSPMKYHGLDKPGMHIGVVGLGGLGHVGVKFAKAMGTKVTVISTSEKKRDEAINRLGADAFLVSRDPKQIKDAMGTMDGIIDTVSATHSLLPLLGLLKHKGKLVMVGAPEKPLELPVMPLIFERKMVMGSMIGGIKETQEMIDMAGKHNITADIELISADYVNTAMERLEKADVRYRFVIDVANTLKPNPNL

SEQ ID NO: 51775 - protein, 355 aa, Panicum virgatum; identical to SEQ ID NO: 4624
  misc_feature: Useful for making plants with altered carbohydrate content

SEQ ID NO: 51776 - protein, 351 aa, Arabidopsis thaliana
  misc_feature: Useful for making plants with altered cell wall content and/or composition
MMARNVLVSGGAGYIGSHTVLQLLLGGYSVVVVDNLDNSSAVSLQRVKKLAAEHGERLSFHQVDLRDRSALEKIFSETKFDAVIHFAGLKAVGESVEKPLLYYNNNLVGTITLLEVMAQHGCKNLVFSSSATVYGSPKEVPCTEEFPISALNPYGRTKLFIEEICRDVYGSDPEWKIILLRYFNPVGAHPSGDIGEDPRGIPNNLMPFVQQVAVGRRPHLTVFGNDYNTKDGTGVRDYIHVIDLADGHIAALRKLEDCKIGCEVYNLGTGNGTSVLEMVDAFEKASGKKIPLVIAGRRPGDAEVVYASTERAESELNWKAKYGIEEMCRDLWNWASNNPYGYDSSSEDNSH

SEQ ID NO: 51777 - protein, 488 aa, Arabidopsis thaliana
  misc_feature: Useful for making plants with altered tocopherol content
MEIRSLIVSMNPNLSSFELSRPVSPLTRSLVPFRSTKLVPRSISRVSASISTPNSETDKISVKPVYVPTSPNRELRTPHSGYHFDGTPRKFFEGWYFRVSIPEKRESFCFMYSVENPAFRQSLSPLEVALYGPRFTGVGAQILGANDKYLCQYEQDSHNFWGDRHELVLGNTFSAVPGAKAPNKEVPPEEFNRRVSEGFQATPFWHQGHICDDGRTDYAETVKSARWEYSTRPVYGWGDVGAKQKSTAGWPAAFPVFEPHWQICMAGGLSTGWIEWGGERFEFRDAPSYSEKNWGGGFPRKWFWVQCNVFEGATGEVALTAGGGLRQLPGLTETYENAALVCVHYDGKMYEFVPWNGVVRWEMSPWGYWYITAENENHVVELEARTNEAGTPLRAPTTEVGLATACRDSCYGELKLQIWERLYDGSKGKVILETKSSMAAVEIGGGPWFGTWKGDTSNTPELLKQALQVPLDLESALGLVPFFKPPGL

SEQ ID NO: 51778 - protein, 446 aa, Panicum virgatum; identical to SEQ ID NO: 4214
  misc_feature: Useful for making plants with altered carbohydrate content

SEQ ID NO: 51779 - protein, 323 aa, Arabidopsis thaliana
  misc_feature: Useful for making plants with altered cell wall content and/or composition
QKLHKISKGTTLSTTLYQTTGNAPGNLGFVNITDLKGGKVGFGSAASGSKLDSSYTKSVKQIPYNISILEIDAPIIAPGVLTAPAPSASLSNITGLLEKAGCKTFANLLVSSGVLKTYESAVEKGLTVFAPSDEAFKAEGVPDLTKLTQAEVVSLLEYHALAEYKPKGSLKTNKNNISTLATNGAGKFDLTTSTSGDEVILHTGVAPSRLADTVLDATPVVIFTVDNVLLPAELFGKSKSPSPAPAPEPVTAPTPSPADAPSPTAASPPAPPTDESPESAPSDSPTGSANSKSANAAVGVSTPSLFTALVTIAAIAVSVSLCS

SEQ ID NO: 51780 - protein, 689 aa, Arabidopsis thaliana
  misc_feature: Useful for making plants with altered cell wall content and/or composition
MEPHRKHSVGDTTLHTCHPCRRTIPYRIYAVFHTCGIIALMYHHVHSLLTANTTLITSLLLLSDIVLAFMWATTTSLRYKPVRRTEYPEKYAAEPEDFPKLDVFICTADPYKEPPMMVVNTALSVMAYEYPSDKISVYVSDDGGSSLTLFALMEAAKFSKHWLPFCKKNNVQDRSPEVYFSSKLRSRSDEAENIKMMYEDMKSRVEHVVESGKVETAFITCDQFRGVFDLWTDKFTRHDHPTIIQLRVSGVMTNSPIILTLDCDMYSNDPATPVRALCYLTDPKIKTGLGFVQFPQTFQGISKNDIYACAYKRLFEINMIGFDGLMGPNHVGTGCFFNRRGFYGAPSNLILPEIDELKPNRIVDKPINAQDVLALAHRVAGCIYELNTNWGSKIGFRYGSLVEDYYTGYRLHCEGWRSVFCRPKRAAFCGDSPKSLIDVVSQQKRWAIGLLEVAISRYSPITYGVKSMGLVTGVGYCQYACWAFWSLPLIVYGFLPQLALLYQSSVFPKSSDPWFWLYIVLFLGAYGQDLLDFVLEGGTYGGWWNDQRMWSIRGFSSHLFGFIEFTLKTLNLSTHGFNVTSKANDDEEQSKRYEKEIFEFGPSSSMFLPLTTVAIVNLLAFVWGLYGLFAWGEGLVLELMLASFAVVNCLPIYEAMVLRIDDGKLPKRVCFVAGILTFVLIVSGYVFLK

SEQ ID NO: 51781 - DNA, 370 bp, Panicum virgatum
  misc_feature: Ceres CLONE 1910273
  misc_feature: Encodes the peptide sequence at SEQ ID NO. 51782
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
gggttcggtcgattctgttcgagccggacggagctgggaggggcggaccccagatccgggcgtnngnnnnnntgatgattgctgtgctggctcttagccggctgcttcgctcctccgcgcggccgtcgggggccgccaccgccgcgggcggagacggggccgcgtgcgatggtggctgggccggggcgcgtccgccatcctctgcgcctttctggttcctgctgcacgagctctgctgccttctcgtcactgttcctcgcgattccatttctccggcctcctcttcttgttgctcttctctccctgcgggatctttccctccaaggactcctcctccttcgcctcggtcctcgtctcgtttcctccacta

SEQ ID NO: 51782 - protein, 254 aa, Panicum virgatum
  misc_feature: Ceres CLONE 1910273
  misc_feature: Useful for making plants with altered cell wall content and/or composition
GRSIRFEPAGARRGGAQIRVPAAMMKSLLPQSQLRRSSARPSGAAAAAGGDGAAADGGGAGARAPASSTFWFLLHALCCLISLFLGFRFSRLLFFLLFSTTALYHSTTSSSSAAVLRATTTTTTTTTTTTTTTNTFTLSFAAANPPPSNPANRTALEAAAAADKGATSGNPQSHVVVGRHEIRIRPWPHPDPVEVMRAHRIMERVQEEQRRWYGVKEPRQVLVVTPTYSRAFQALHLTGLLHSLRNVPYPLTWI

SEQ ID NO: 51783 - DNA, 661 bp, Panicum virgatum
  misc_feature: Ceres CLONE 2013189
  misc_feature: Encodes the peptide sequence at SEQ ID NO. 51784
aactccaatttcacttcacctcgacagcgcacaccccacccaccggtctccctcctcctccaccaccaccgaatcccaagccaaggcacagactgagcaggggggctttctcctctccttcccttcctcgccgccttcgcccggcgagccagccagccatggagccggcggcgaagacggtggagcggctggcgcagcgcctggtgccgccggcggagcccacgcccaccggcccgcaccgcctgtcctggctcgaccgctacccgacccagatggcgctcatcgagtcgctgcacgtcttcaagcccgacccggcgcgggacggggtcagccccgcggagaccatccagcgcgccctggcgcgggcgctcgtcgagtactacccgctcgcgggccgcctcgccgtgtccgacgccgccggggggctccacgtcgactgcagcggcgagggcgtctggttcgtcgaggccgccgtgcggtgccggctcgaggacgtcgactacctcgagtacccgctgcagatccccaaggacgacctgctcccgcacccgctgccgcgccccacccgcgaggaggagaacaagctcatcctgctcgtccaggtgaccacgttcgggtgcggcggcttcgtggtggggttccggttcagccacgcggtggc

SEQ ID NO: 51784 - protein, 167 aa, Panicum virgatum
  misc_feature: Ceres CLONE 2013189
  misc_feature: Useful for making plants with altered cell wall content and/or composition
MEPAAKTVERLAQRLVPPAEPTPTGPHRLSWLDRYPTQMALIESLHVFKPDPARDGVSPAETIQRALARALVEYYPLAGRLAVSDAAGGLHVDCSGEGVWFVEAAVRCRLEDVDYLEYPLQIPKDDLLPHPLPRPTREEENKLILLVQVTTFGCGGFVVGFRFSHAV

SEQ ID NO: 51785 - DNA, 719 bp, Panicum virgatum
  misc_feature: Ceres CLONE 1908656
  misc_feature: Encodes the peptide sequence at SEQ ID NO. 51786
taataccgcgctgcccccgctccttttccctttcccttttttctcctcgtcttccttcccccgcccgctgctctcctcccctgcgtgcgagagcaccagcagcttccgcttccaattccgccgcccccgccgccgtgcctctcctccattggctcgccgtcgccgcggcctcgaccgcctcgcctcacccgtcgccaccggcctcgtcacctcctgtgctactccgtgccatcggggcctaacagggacggcctacccgcacagcggaggacggcgtcaggacaagcgctcccgagcaacaagtatcccggcagcgcttcgctgccgctcggcgctcgagctccacatacaccagcagcagcagcacgccagcacgagcggaagcgggagggagcgctggctgcttgattcggtcaactcccgcgcgctcgcggcaggatcaaggccaatggggcgggagaggaggccgtggccggcggcggccgccgccgttcttctgctcgtcgcctcctgcgtcgccgcggcgccgctgcagcagcaccagcgcgccaggatcacaggggacgccggcggcgtgctggacgacaacccggtggggaagctgaaggtgttcgtgtacgagatgccgcgcaagtacaaccagatgctgctgtccaaggacagccggtgcctgcaccacatgttcgcggccgagatcttcacgcaccagttcctgcggt

SEQ ID NO: 51786 - protein, 418 aa, Panicum virgatum; identical to SEQ ID NO: 16394
  misc_feature: Ceres CLONE 1908656
  misc_feature: Useful for making plants with altered cell wall content and/or composition

SEQ ID NO: 51787 - DNA, 632 bp, Panicum virgatum
  misc_feature: Ceres CLONE 1885540
  misc_feature: Encodes the peptide sequence at SEQ ID NO. 51788
tcgcctcctcccacacctctgccctgcctgccacccttttgactcctcggcctcgcccttcactctcctccacctcgctgccaagcaatcactcccactacctttccctccgccgcttgtctacctcgcctggtccgctccggctctcgatctctccccgttcctcctgaccgcgccgccgggcggtgggggagaaggcggcggcggcgctgcgggtggcggacggctaaatggggacgggtggcgcgccggcgccggccctggcgctcgccttgcttctcgcctgcgcccacgtcgccctcgtcgcggcgcaggacaccgagcggatcgaaggaagtgctggtgatgtgctagaagatgatcctgtcgggaggctcaaggtatatgtgtatgagttgcccaccaagtacaacaagaagatggtggccaaggattctagatgcctcagccacatgtttgctgcagagatcttcatgcaccggtttctattgtctagtgcaatccggactttaaatccagaagaagctgattggttctatactccagtatacacgacatgcgacctgactccatggggtcatcccttgccctttaagtctccaaggataatgagaagcgcaattcagttcatt

SEQ ID NO: 51788 - protein, 222 aa, Panicum virgatum
  misc_feature: Ceres CLONE 1885540
  misc_feature: Useful for making plants with altered cell wall content and/or composition
MRSAIQFISKHWPYWNRTEGADHFFVVPHDFGACFHYQEEKAIERGVLPLLRRATLVQTFGQKDHVCLKEGSITIPPYAPPQKMKTHLVPPETLRSIFVYFRGLFYDTANDPEGGYYARGARASVWENFKNNPLFDISADHPPTYYEDMQRAVFCLCPLGWAPWSPRLVEAVVFGCIPVIIADDIVLPFADAIPWEEIGVFVAEDDVPKLDTILTSIPMGVI

SEQ ID NO: 51789 - DNA, 1215 bp, Panicum virgatum
  misc_feature: Ceres CLONE 1985706
  misc_feature: Encodes the peptide sequence at SEQ ID NO. 51790
aagctttagaagaaagaggcgcgggccgcggtggcgatcgctgatatatcagcagcaaccctgcctggaaggtgcgcgttttgttccatttgtgtgcgtgggcggtgatggcgtcgtcaacggcgtactcgcggccgtccaagccgccggggccggcggccggcgaccggagagggccgcggcttgccaaggaactcggcaagatcgagcccaagaagctgggcatcgggctggtggccggctgctgcctcgcgctgctcacctacctgtcctttgccaggctcttcgctatctactcgccagttttcgatagctcggccctggtgttgaggaacgcgccgccggcaaccacaacggtgccggcaacagaggctccgccggtggagcaaaagactgaagtggaggagcagaaagatgttacggaccctgaggcggaccccaacatgaccaacttaccagaggtcacaagaaaggatgaacaggaggactcggcggcgacgaagccagcttctgccgccacggaggccaagatcacctgcgacgagaacggcgttgacgagggcttcccgtacgcgcgcccgccggtgtgcgagctcaccggcgacatccggatcagccccaaggagaaaaccatgtacttggtgaacccgtccggcgccgggcccttcgacgccaacggcgagaagaagatccgcccgttcgcccgcaaggacgacttcctcctcccgggcgtcgtggaggtcacgatcaagtccgtgtcctcggccgaggccgcaccgcagtgcacgcggcggcacgacgtccccgtggtagtcttctccgtggccggctacacggacaacttcttccacgacaacacggacgtgctcatcccgctgttcctcaccacggcgcacctcaagggcgaggtgcagctcctcatcaccaacttcaagccgtggtgggttcacaagttcacgcccctgctcaagaagctctccaactacgacgtgatcaacttcgacaaggacgagggggtgcactgtttccgggcaggccacctcgggatgtaccgcgaccgcgacctcatcatctccccgcacccgacgcgcaacccacacaactactccatggtcgactacaaccggttcctccgccgcgccttcgccctgccccgcgacgccccggccgtgctcggggaggagaccagcgccaagcccaagatgctcatcatcg

SEQ ID NO: 51790 - protein, 530 aa, Panicum virgatum
  misc_feature: Ceres CLONE 1985706
  misc_feature: Useful for making plants with altered cell wall content and/or composition
MASSTAYSRPSKPPGPSAGDRRGPRLAKELGKIEPKKLGIGLVAGCCLALLTYLSFARLFAIYSPVFDSSALVLRNAPPATTTVPATEATPVEQKTEVEEQKDVTDPEADPNMANIPEVTRKDEQEDPAATKPAASATEAKITCDENGVDEGFPYARPPVCELTGDIRISPKEKTMYFVNPSGAGPFDANGEKKIRPFARKDDFLLPGVVEVTIKSVSSAEAAPECTRRHDVPVVVFSVAGYTDNFFHDNTDVLIPLFLTTAHLKGEVQLLITNFKPWWVHKFTPLLKKLSNYDMINFDKDEGLHCFRVGHLGMYRDRDLIISPHPTRNPHNYSMVDYNRFLRRAFALPRDSPAVLGEETGATPKMLIIERKGTRKLLNLREVSAMCEELGFTVTVAEAGGDVRGFAERVNAADVLLAVHGAGLTNQIFLPTGAVLVQIVPWGKMDWMATNFYGQPARDMRLRYVEYYVSEEETTLKDKYPRDHYVFMNPMRIHGEGWPAIAEIIMKQDVMVNMTRFKPFLLKALDELQE

SEQ ID NO: 51791 - DNA, 594 bp, Panicum virgatum
  misc_feature: Ceres CLONE 1890796
  misc_feature: Encodes the peptide sequence at SEQ ID NO. 51792
aaaaaggtgcatccatcgtggcctccgactccatctatctatcctcttcctctccagcgccacgccgcgctagttcacacagcacacatccctctgcagactccggccctgcggggggcggcgccatggcggctgcgaatgggagcggcggcaaggggttcgaggtgcccaaggtggaggtcaggttcaccaagctcttcatcaacggccagttcgtcgacgccgtctccggtaagacgttcgagacccgggacccgcgcaccggcgaggtcatcgccaacatcgccgagggcgacaaggccgacgtcgacctcgccgtcaaggccgcccgggaggccttcgacaatggcccctggcccaggatgtcgggctatgagcggggccggatcctgtacaagttcgcggacctgatcgaccagcacgtcgaggagctggcgatgctggacacggtggacgccggcaagctcttcctcgtcggcaaggtctgggacatcccgggcgccgcgcacctgctgcgctactacgccggcgccgccgacaagatccacggcgagacgctcaagatggcgcagcggatgcacgggtacacgctca

SEQ ID NO: 51792 - protein, 156 aa, Panicum virgatum; identical to SEQ ID NO: 50620
  misc_feature: Ceres CLONE 1890796
  misc_feature: Useful for making plants with altered cell wall content and/or composition

SEQ ID NO: 51793 - DNA, 485 bp, Panicum virgatum
  misc_feature: Ceres CLONE 1903353
  misc_feature: Encodes the peptide sequence at SEQ ID NO. 51794
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (444)..(444): n is a, c, t, g, unknown, or other
  misc_feature (445)..(445): n is a, c, t, g, unknown, or other
gtttcgtgcgccgcacttctccccccacctacctctccccctcaaaaactatccgcctccgcccgccgacgagcgcgatcggtcgattcggttcgggccggccggagctcggaggggcggagcccagatccgggtgccggcggcgatgatgaagtcgctgctgccgcagagccagctgcggcgctcgtcggcgcggccggcgggggccgccgccgccgcgggcggagacggggccgcggccgacggcggcggggccttggcgggggggcccgcctcgggcaccttctggtgcctgctcctcgcgctctgctgccacatctcgctcttcctcgggnnnnnttactcgcggctcctcttcttcctgctcttctccaccaccgcgctctaccgctgcgccacctcggcctcctcagctgcggtcctgcgcgtcattgcgacgatacnngaccaccacgaccccgactacgaccacccccaacatcttc

SEQ ID NO: 51794 - protein, 161 aa, Panicum virgatum
  misc_feature: Ceres CLONE 1903353
  misc_feature (112)..(112): Xaa is any aa, unknown, or other
  misc_feature (113)..(113): Xaa is any aa, unknown, or other
  misc_feature (148)..(148): Xaa is any aa, unknown, or other
  misc_feature: Useful for making plants with altered cell wall content and/or composition
FRAPHFSPHLPLPLKNYPPPPADERDRSIRFGPAGARRGGAQIRVPAAMMKSLLPQSQLRRSSARPAGAAAAAGGDGAAADGGGALAGGPASGTFWCLLLALCCHISLFLGXXYSRLLFFLLFSTTALYRCATSASSAAVLRVIATIXDHHDPDYDHPQHL

SEQ ID NO: 51795 - DNA, 1606 bp, Panicum virgatum
  misc_feature: Ceres CLONE 1826959
  misc_feature: Encodes the peptide sequence at SEQ ID NO. 51796
aggtgagccacagctagccggtgcgcgcgccccccagatcccccaccggcggcggccaccatgcggagcgcggcggctgcggccacggtgacgcgcgtggcgcagcgggtggtggccccgtcggcgcccacgccccgcggcgagctgcctctctcgtggctcgaccgctacccgacgcagcgcgcgctcatcgagtccctccacgtcttcaagggccgcgccggcaccggcggcgacgccgacgccgaggcgcccgccagggccatcgagcccgcgctggccaccgcgctcgtgagctactaccccatcgccggccggctcgcggtctcgggcgagggggacctggtggtggactgcacgggcgagggcgtctggttcgtcgaggccacggcgagctgcacccttgaggacgtggactacctcgagtacccgctcatggtgcccaaggacgagctcctgccgcaccccacctacccggcctccgatcccctccccgaggactcgctcatcctccttgtccaggtgacgcagttcgcgtgcggtggcttcgtggtggggttccggttcagccacgccgtcgccgacgggcccggcgcggcgcagttcatggcggccgtgggcgacgtcgcgcgcgggcacgcggcgccgctggtggccccggcgtgggcccgcgaggcgatcccgagcccccccgccggcgcggcggtgggcccgctcccggccccgacggagctccggctccagtacctggccatggacatctcggcggagtacatcgagcgcctcaaggcccggttcctggagcggacgggccaccggtgcagcgccttcgaggtggtcatcgccaaggcgtggcagtcccgcacccgcgcggccgggttcgcgccggggacccccgtgcacgtctgcttcgccatgaacgcgcggccggcggtggcggcgctccgcgggcgtgcgctccccgagggattctacggcaactgctactacatcatgcgcgtgacggcggacgccggggccgtggccggcgcggcggcgcacgacgtggtgcggctggtccgcgagggcaagcggcggctgccgggcgagctggcgcggtgggtcgccggcggcggggagggggaaggggggggacccgtaccggatcacgtcggactaccggacgctgctggtgtcggactggtcgcggctggggttcgcggaggtggactacgggtggggccgccccgcgcacgtggtcccgctcaccaacctcgactacatcgcgacgtgcatcctggtgcggccgccggcgcgcaagcccggcgcgcggctcatcacgcagtgcgtcgccgccggcgccgtcgacgacttccacaagggcatgatgcgcctcgacgactgatcagtgcttgctcgatgcgatgatgctgatgctccctccccctgcgacctgctattagtaatttaatccccagctgcgtaaattcagttcgttcgttcgttagttgccgtaccccatgactgggtatgggtagttgtcttgttgacgagtgcgaactatttattgtatgtacaaaaagattttttttaaagaaaagatggagcaccgcccgtggattttgcc

SEQ ID NO: 51796 - protein, 448 aa, Panicum virgatum
  misc_feature: Ceres CLONE 1826959
  misc_feature: Useful for making plants with altered cell wall content and/or composition
MRSAAAAATVTRVAQRVVAPSAPTPRGELPLSWLDRYPTQRALIESLHVFKGRAGTGGDADAEAPARAIEPALATALVSYYPIAGRLAVSGEGDLVVDCTGEGVWFVEATASCTLEDVDYLEYPLMVPKDELLPHPTYPASDPLPEDSLILLVQVTQFACGGFVVGFRFSHAVADGPGAAQFMAAVGDVARGHAAPLVAPAWAREAIPSPPAGAAVGPLPAPTELRLQYLAMDISAEYIERLKARFLERTGHRCSAFEVVIAKAWQSRTRAAGFAPGTPVHVCFAMNARPAVAALRGRALPEGFYGNCYYIMRVTADAGAVAGAAAHDVVRLVREGKRRLPGELARWVAGGGEGEGGGPVPDHVGLPDAAGVGLVAAGVRGGGLRVGPPRARGPAHQPRLHRDVHPGAAAGAQARRAAHHAVRRRRRRRRLPQGHDAPRRLISACSMR

SEQ ID NO: 51797 - DNA, 742 bp, Panicum virgatum
  misc_feature: Ceres CLONE 2040682
  misc_feature: Encodes the peptide sequence at SEQ ID NO. 51798
atggtgagcagctacctcccgaagttttctgatcctacttcttcagttatcgacttcttgcatgttcgagttagggtctctcctcttgcatttgttgcgcacacaagctgttcggcggaatgaacaagcgaggacaatttggtgacacacgggttcaattagagtttacaagtggaagcgtatgggtaccaaggaagcatcccctcctactgtcctctgcctcttctttctgttctgcttaggcggcaaatgcctagcgtcagaattccaagctacccagacagcaaccctcacggttgatgcctcaccgcagcttgctcggaagattcctgacacactatttgggatcttttttgaggagatcaaccatgcaggagctggtggaatatgggctgaactcgttagtaacagaggttttgaagctggaggcccccatactccatcgaacattggcccatggtccatcattggagatgactcttccatatttgtggcgactgatcgtacatcatgtttcaatcgaaacattgttgctctaaggatggaggtcctctgcgataactgtccagctgggggtgttggcatttacaacccaggattctggggcatgaacatagaagatggaaagacatacaacctagttatgtatgctaagtcgccagaaacaacagacttgacagtttcgctaacgagtgctgatgggtcacaaagtctggcttcagctacggtcaccgtctctggg

SEQ ID NO: 51798 - protein, 187 aa, Panicum virgatum
  misc_feature: Ceres CLONE 2040682
  misc_feature: Useful for making plants with altered cell wall content and/or composition
MGTKEASPPTVLCLFFLFCLGGKCLASEFQATQTATLTVDASPQLARKIPDTLFGIFFEEINHAGAGGIWAELVSNRGFEAGGPHTPSNIGPWSIIGDDSSIFVATDRTSCFNRNIVALRMEVLCDNCPAGGVGIYNPGFWGMNIEDGKTYNLVMYAKSPETTDLTVSLTSADGSQSLASATVTVSG

SEQ ID NO: 51799 - DNA, 675 bp, Panicum virgatum
  misc_feature: Ceres CLONE 1859352
  misc_feature: Encodes the peptide sequence at SEQ ID NO. 51800
atatatgttaataattcactcggttgaggacgccctcttagcttgggcctatatatactcgtgccatctcctccacatttcatcatgcatgagcactctctcacacactactacctccctatcttataacgcgatcgatcgaccctgattaaaggtagccaagtgatcatcgtatcactcgagggaggagttaaagaaaaattaaaggaaggtgcggctccgttgaagtggccggccggccggtgagctagctagggagcgagcgagcatgggtaccatcgggttcccggtgacgaggaggagcaggtcgctggtggcgccgtcgtcggcgacgccgcaggagacgctgcggctgtcggtgatcgaccgcgtggcggggctgcggcacctggtgcggtcgctgcacgtgttcgacggccggcgcggcggggaggcggtggtgaataataataagacgccggcgccggcgccggcggagacggtgcgggaggcgctggggaaggcgctggtggactactacccgttggcggggcggttcgtggaggaggacggggaggtgcgggtggcgtgcacggcggagggcgcgtggttcgtggaggcggaggcggcgtgcaccctggaggaggtgaagcacctggaccaccccatgctcatccccaaggaggacctgctgcc

SEQ ID NO: 51800 - protein, 438 aa, Panicum virgatum; identical to SEQ ID NO: 3706
  misc_feature: Ceres CLONE 1859352
  misc_feature: Useful for making plants with altered cell wall content and/or composition

SEQ ID NO: 51801 - DNA, 606 bp, Panicum virgatum
  misc_feature: Ceres CLONE 2054220
  misc_feature: Encodes the peptide sequence at SEQ ID NO. 51802
acctcacctccgctccgcatgcgctgtgtcgtgcacctctcttctccccccacttacctcttcccctactatactattcccctcccccagcagaccaatgcgatcattcgattcggttcgggccgacctgagatgggaggagcggagatcagattgcggtgcgcgatgatatgatgaatgctgtgctgcagccaactccgctgctgcgctcgtcggcccggccgggcggggccgcccccgccccgagacgagaccgcgcctcagctgagcggggccgtgccttggccccccccctcgcgtagggtatgttctgggttctgctccctctgctctgctgtctcattcctctcttcgttgggtttcgcttctctcggcttctcttcgttctgctcttctacaccactgtgctctaccactccatcatcttcttctgctccggcgcggtcctgcacgccaacaacaccaccaccaccaacaccaacaccaccaccaccacaactattctctttatgctctccttcggggaagcgaaccctctgccctccaacccagccaaccgcactggactggacgtgggctccggagcaggccacgacgcgacctaag

SEQ ID NO: 51802 - protein, 99 aa, Panicum virgatum
  misc_feature: Ceres CLONE 2054220
  misc_feature: Useful for making plants with altered cell wall content and/or composition
MFWVLLPLLCCLIPLFVGFRFSRLLFVLLFYTTVLYHSIIFFCSGAVLHANNTTTTNTNTTTTTTILFMLSFGEANPLPSNPANRTGLDVGSGAGHDAT

SEQ ID NO: 51803 - DNA, 706 bp, Panicum virgatum
  misc_feature: Ceres CLONE 1904658
  misc_feature: Encodes the peptide sequence at SEQ ID NO. 51804
atctgcccgcgccgcgacccgagcttcctcggtcagtcctctcccccgtcgccgcggcgcgacccacaccgcttgcgtggctcccgtagcccctatgcgcacacttcccttcaaagccactgattcatccccgttcctctacttaagcgcacgcctccagggattccttcctgtgtcctgcactcgctcgcctcttccgtcgggaggggaggtcttggatgctgcccgcatgacacacgggttcaattagagtttacaagtggaagcgtatgggtaccaaggaagcatcccctcctactgtcctctgcctcttctttctgttctgcttaggcggcaaatgcctagcgtcagaattccaagctacccagacagcaaccctcacggttgatgcctcaccgcagcttgctcggaagattcctgacacactatttgggatcttttttgaggagatcaaccatgcaagagctggtggaatatgggctgaactcgttagtaacagaggttttgaagctggaggcccccatactccatcgaacattggcccatggtccatcattggagatgactcttccatatttgtggcgactgatcgtacatcatgtttcaatcgaaacattgttgctctaaggatggaggtcctctgcgataactgtccagctggtggtgttggcatttacaacccaggattctggagcatgaacataga

SEQ ID NO: 51804 - protein, 656 aa, Panicum virgatum; identical to SEQ ID NO: 972
  misc_feature: Ceres CLONE 1904658
  misc_feature: Useful for making plants with altered cell wall content and/or composition

SEQ ID NO: 51805 - DNA, 689 bp, Panicum virgatum
  misc_feature: Ceres CLONE 1857797
  misc_feature: Encodes the peptide sequence at SEQ ID NO. 51806
accaaattgatagcccacctcacctcacctcacctcacctccgcacccgctgtttcgtgcaccgcacttctccccccacccacctctccccctcaaaaactatccgcctccgcccgccgacgagcgcgatcggtcgattcggttcgggccggccggagctcggaggggcggagcccagatccgggtgccggcggcgatgatgaagtcgctgctgccgcagagccagctgcggcgctcgtcggcgcggccgtcgggggccgccgccgccgcgggcggagacggggccgcggctgacggcggcggggccttggcgcgggcgcccgcctcgggcaccttctggttcctgctccacgcgctctgctgcctcatctcgctcttcctcgggttccgcttctcgcggctcctcttcttcctgctcttctccaccaccgcgctctaccactccaccacctcgtcctcctccgccgcggtcctgcgcgccaccacgacgaccacaaccaccacgaccacgacgaccaccaccaccaacattttcacgctctccttcgcggcggcgaaccctccgccctccaaccccgccaaccgcaccgcgctggaggcggcctcggcggcggacaagggcgcgacctccgggaacccccagagccacgtggtggtggggcggcacgggattcggatcggcccgtggc

SEQ ID NO: 51806 - protein, 164 aa, Panicum virgatum
  misc_feature: Ceres CLONE 1857797
  misc_feature: Useful for making plants with altered cell wall content and/or composition
MMKSLLPQSQLRRSSARPSGAAAAAGGDGAAADGGGALARAPASGTFWFLLHALCCLISLFLGFRFSRLLFFLLFSTTALYHSTTSSSSAAVLRATTTTTTTTTTTTTTTNIFTLSFAAANPPPSNPANRTALEAASAADKGATSGNPQSHVVVGRHGIRIGPW

SEQ ID NO: 51807 - DNA, 617 bp, Panicum virgatum
  misc_feature: Ceres CLONE 1884308
  misc_feature: Encodes the peptide sequence at SEQ ID NO. 51808
aggtgagccacagctagccggtgcgcgcacccaccaccaccgccggtccaccgccgcgtccgcgtgcccctccagatcccccgccggcggcggccaccatgcggagcgaggcggcggcggcggcggccaccatgcggagcgaggcggcggcggcggcggccacggtgacgcgcgtggcgcagcgggtggtggccccgtcggcgcccacgccccgcggcgagctgccgctctcctggctcgaccgctacccgacgcagcgcgcgctcattgagtccctccacgtcttcaagggccgcgccggcaacgacggcgacgccgaggtgcccgcccgggtcatcgagcgcgcgctggccaccgcgctcgtgagctactaccccatcgcaggccggctcgcggtctccggcgagggggacctggtggtggactgcacgggcgagggcgtctggttcgtcgaggccacggcgagctgcaccctcgaggacgtggactacctcgagtacccgctcatggtgcgcaaggacgagctcctgccgcaccccacctacccggcctccgaccccctccccgaggactcgctcatcctccttgtccaggtgacgcagttcgcgtgcggcggc

SEQ ID NO: 51808 - protein, 209 aa, Panicum virgatum
  misc_feature: Ceres CLONE 1884308
  misc_feature: Useful for making plants with altered cell wall content and/or composition
MRSEAAAAAATMRSEAAAAAATVTRVAQRVVAPSAPTPRGELPLSWLDRYPTQRALIESLHVFKGRAGNDGDAEVPARVIERALATALVSYYPIAGRLAVSGEGDLVVDCTGEGVWFVEATASCTLEDVDYLEYPLMVRKDELLPHPTYPASDPLPEDSLILLVQVTQFACGGFVVGFRFSHAVADDPGAAQFMAAMGDVARGTRRRCW

SEQ ID NO: 51809 - DNA, 690 bp, Panicum virgatum
  misc_feature: Ceres CLONE 1890076
  misc_feature: Encodes the peptide sequence at SEQ ID NO. 51810
ggggggagaagcccggtggcgccgaggatgaagaaccgcgagactgcgtggaggaggggccactggagttggtataactccaatttcacttcacctcgacagcgcacaccccacccaccggtctccctcctccaccaccaccgaattagccaaggcacaggcggagcaggggggcctctcctctccttcccttcctcgccgccttcgcccggcgagccagccagccatggagccggcggcgaagacggtggagcggctggcgcagcgcctggtgccgccggcggagcccacgcccaccggcccgcaccgcctgtcctggctcgaccgctacccgacccagatggcgctcatcgagtcgctgcacgtcttcaagcccgacccggcgcgggacggggtcagccccgcggagaccatccagcgcgccctggcgcgggcgctcgtcgagtactacccgctcgcgggccgcctcgccgtgtccgacgccgccggggggctccacgtcgactgcagcggcgagggcgtctggttcgtcgaggccgccgttcggtgccggctcgaggacgtcgactacctcgagtacccgctgcagatccccaaggacgacctgctcccgcacccgctgccgcgccccacccgcgaggaggagacaagctcatcctgctcgtccaggtgaccacgttcgggtgcggc

SEQ ID NO: 51810 - protein, 431 aa, Panicum virgatum; identical to SEQ ID NO: 3332
  misc_feature: Ceres CLONE 1890076
  misc_feature: Useful for making plants with altered cell wall content and/or composition

SEQ ID NO: 51811 - DNA, 642 bp, Panicum virgatum
  misc_feature: Ceres CLONE 2045284
  misc_feature: Encodes the peptide sequence at SEQ ID NO. 51812
actcccctgccgcctgctggccgccggctgaagtgagacaggcgaggccaccgatcaatcgacgcccgtttcgttgtcgcagggtctcacacgatcgtcgagccctctccgcagaagctgacgacgcttcgctcgtttgttaaaacgttgctggggttgcagcaagtgtagttgggcatatagagagattgcattgagttagtgctctgctctcggctgtagggacgcaatgggcgtcctaaaagctggttcgctttgctggctgttccatgtgctggttcttgtctgtgccttgtgtcagatacttcatgttggatcaattggggctcaaactgctcagttgagtgtggatgcttcacctcagaatgctcaggtgatccctggaaatatgtttggcatcttcttcgaggagatcaaccatgctggagctggtggattgtgggcagagcttgtaagcaacagaggttttgaagctggtggtcctaatactccttcaaacattgacccatggttgaccattggagatgaatccaatattatcgtggcaacagatcggtcatcctgttttgctggtaacccaattgcacttcgaatggaagtacattgtgaaactagtggaactaatgcctgcccatcaggagg

SEQ ID NO: 51812 - protein, 162 aa, Panicum virgatum; identical to SEQ ID NO: 31438
  misc_feature: Ceres CLONE 2045284
  misc_feature: Useful for making plants with altered cell wall content and/or composition

SEQ ID NO: 51813 - DNA, 1710 bp, Panicum virgatum
  misc_feature: Ceres CLONE 1991875
  misc_feature: Encodes the peptide sequence at SEQ ID NO. 51814
acacacacacacacacacagcctagctagctagctagcaacaaagttcgttcgttctagggctagcaagcagttcgtgatcacgcacgcgtagcgggtggccatggggttcgcggtgcggaggacgagccggtcgtacgtgcgcccaagcgccgcgacgccgtccggcgcgctggagctctccatcatcgaccgcgtcgtcgggctgaaccacctggtgcgctccctccacgtcttcgccgccgcggccgcgcccgtcgccgggcggcaggacgacgacgcttggacgacgtcgccgtccccggcgcgcgcgctccgggaggcgctcgggaaggcgctggtggactactacccgttcgcggggcggcctcgtggacggcgctggcgggccgggggtctcgcgcgtggagtgcaccggcgagggcgcgtggttcgtggaggccgccgccgcgttcagcctggacgacgccggccgcctcgaccagtacccgtacgtcatcccggaggacgacctgctgccggacgccgcgccggacgtcgagccgctcgacctcccgctcgcgatgcaggtgacggagttcagctgcggcagcttcgtggtggggctcatctgctgccactccctggccgacggcctcggcgccgcccagttcatcaacgccgtcggcgactacgcccgcggcctccccaagcctcgcgtgagccccgtctgggagcgcgacatcatcccgagcccgctcagcctgtcctccgcgccgcccgtcttctcgcggatgttccagttccggcacctcgccgtcgacctcagcctcgacggcatcgcccgggtcaagtcccagttcctccagtccacggggcagcgctgctccaccttcgacgtcaccgtcgccaaggtgtggcaggcgcgcacgcggtcgctgcgcctcgccgacccggccacgcgcgtcagtctctgcttcttcgccaacacgcgccacctcctgtgcggcggcgccgccgccgccgccgggttctacggcaactgcttctacacggtgactgtgagcgccaagagcagcgcggtggtgggcgcggacacggccggcgtcgtggccatgatccgggacgccaaggcgcggctccccgccgagttcgcgcggtgggcggcgggcgagctcgtggcgcaggacccctacgagctgagcttcacgtacgagtcgctgttcgtgtcggactggacgcggctggggttcctggaggcggactacggctggggcacgccggagcaggtgatacccttcacgtaccacccgtgcatgcccatcgcggtcatcggcccgccgccggcgcccaagacgggggcgagggtcacgacacggtgcgtcgaggaggagaacctgcaggagttcatggacgagatgaaagcatttcagaagtgacacgacgacgacgaccactatgctccgacatggcgcacctgctctgctctcatcgactttctttgcttctcttgtgtctaataatactgtttgtgtggactttgcttcaatgtgtgcgtgtgctatttataaaaaaaaaattgtgtgtactgcttgtgcactctggctgtttttaagtttttgggttgtatcttgggctaaaaatggatgtgtaataagatgtggcccgcccactcatggaaattgtaagatacagtttgtacgatcctctaaaaaaaagatacagtttgtac

SEQ ID NO: 51814 - protein, 496 aa, Panicum virgatum
  misc_feature: Ceres CLONE 1991875
  misc_feature: Useful for making plants with altered cell wall content and/or composition
MGFAVRRTSRSYVRPSAATPSGALELSIIDRVVGLNHLVRSLHVFAAAAAPVAGRQDDDAWTTSPSPARALREALGKALVDYYPFAGRPRGRRWRAGGLARGVHRRGRVVRGGRRRVQPGRRRPPRPVPVRHPGGRPAAGRRAGRRAARPPARDAGDGVQLRQLRGGAHLLPLPGRRPRRRPVHQRRRRLRPRPPQASREPRLGARHHPEPAQPVLRAARLLADVPVPAPRRRPQPRRHRPGQVPVPPVHGAALLHLRRHRRQGVAGAHAVAAPRRPGHARQSLLLRQHAPPPVRRRRRRRRVLRQLLLHGDCERQEQRGGGRGHGRRRGHDPGRQGAAPRRVRAVGGGRARGAGPLRAELHVRVAVRVGLDAAGVPGGGLRLGHAGAGDTLHVPPVHAHRGHRPAAGAQDGGEGHDTVRRGGEPAGVHGRDESISEVTRRRRPLCSDMAHLLCSHRLSLLLLCLIILFVWTLLQCVRVLFIKKKLCVLLVHSGCF

SEQ ID NO: 51815 - DNA, 1865 bp, Panicum virgatum
  misc_feature: Ceres CLONE 2013748
  misc_feature: Encodes the peptide sequence at SEQ ID NO. 51816
aactaccgttccgcccctataagaaaccctgcgtcgctcgatcgctatgcaaccccaaccccgtcgagccatctcctttctcctgagctccttccattccattcccaagctaagctagcagacaaggccgcggatccatgggcgtcttcacggtgaccaagctgtccgaggggcccgtgcggccgtccgccgccacgccgtcggggacgctgcccatggcctgggtcgaccggtacccgacgcaccgcggcctcgtcgagtccgcgcacatctaccgcaacgtcgacgacatgccggcgccggcagcggagcgagaggctggtggcactggcgccaaggccgccgccgccgccctcgccctgcaggcgccggacaaggaggcgatgatgaacggcagcaagtccccggccgcggtggtgcgcggcgcgctggcggacgcgctggtgcactactacccgttcgcggggcggatcgtggaggacgtccccggccggcccgccgtgctgtgctccggcgagggcgtctacttcgtggagggcgccgccaactgcaccctcgccgacgtcaacttcctggagcgcccgctgctgctcgccaaggagcagctcgtgccgtgcccgacgccggagctctggcccgtcgagccgcacaacaccctcgccatgatacaggtcacgaccttcacctgcggcggcttcgtggtcggcctgcgcaccaaccacgcggtggcggacggcacgggcgcggcgcagttcctgaacgccgtcggcgacctcgcccgcgggctgccggagccccgcgtgaagcccgtctgggcccgggaccgcttccccgacccggacatcaagcccggcccgctcccggagctgccggcgctggccctcgagtacatcgcgttcgacttcccggccgcctacctcggcaagctcaagtcgcagtacgcggcgtccacgggcggcaagatctgctccgccttcgacatcgtcatcgccaagctctggcagtgccggacgcgcgccatcggcgccgcgcccggcgccgacgtcaggctctgcttcttcgccagcgcccgccacgtgctgaagctggagccggggtactacggcaacgccatcttccccgtgaaggtgtcggcgccggcggagaaggtggccgggtcgtcggtgatcgagctcgtcggcatggtgcgcgacgcgaagcggcggatggccgaggagtgcctgagctgggccgagggccgcaccggcgggcgcgacccgttccagatgaccttcagctacgagtccgtgtacgtgtcggactggagcaagctcgggttcaacgacgtggactacgggtacggcacgccggtgtccgccggcccgctggtgaactgcgacctcatcgcgtcggccatcgtcatgagggcgccggcgccgctcgccggcacgcggctgctggccagctgcgtcaccaaggagcacgccgacgacttcgcccgcaggatgcgggaggatctcgtgtgatgatgcgggcttgcatacgtgaaggaactcggccgccgtaccgtatgtccgtatcacatatctgcctatctacgatacgtgtcatcgatcagagctagtggtggtgggagctacatacgaaatgggaattggtgttcctgtctggaccgtaactatagtattgcactagttggtgtacaaagtgtgtgcaaatgaacaaattttcatggagttgttgagcggaactagctagccagtgttcatgacaagaaaaacactccatgagagtcgggttacaccttgcctstasmgagtatctsagyggatgtaaaatgttgtaacaatccatatcatatcatatcatatcatatcatatcattc

SEQ ID NO: 51816 - protein, 455 aa, Panicum virgatum
  misc_feature: Ceres CLONE 2013748
  misc_feature: Useful for making plants with altered cell wall content and/or composition
MGVFTVTKLSEGPVRPSAATPSGTLPMAWVDRYPTHRGLVESAHIYRNVDDMPAPAAEREAGGTGAKAAAAALALQAPDKEAMMNGSKSPAAVVRGALADALVHYYPFAGRIVEDVPGRPAVLCSGEGVYFVEGAANCTLADVNFLERPLLLAKEQLVPCPTPELWPVEPHNTLAMIQVTTFTCGGFVVGLRTNHAVADGTGAAQFLNAVGDLARGLPEPRVKPVWARDRFPDPDIKPGPLPELPALALEYIAFDFPAAYLGKLKSQYAASTGGKICSAFDIVIAKLWQCRTRAIGAAPGADVRLCFFASARHVLKLEPGYYGNAIFPVKVSAPAEKVAGSSVIELVGMVRDAKRRMAEECLSWAEGRTGGRDPFQMTFSYESVYVSDWSKLGFNDVDYGYGTPVSAGPLVNCDLIASAIVMRAPAPLAGTRLLASCVTKEHADDFARRMREDLV

SEQ ID NO: 51817 - DNA, 719 bp, Panicum virgatum
  misc_feature: Ceres CLONE 1886975
  misc_feature: Encodes the peptide sequence at SEQ ID NO. 51818
aacctcaaccccaccgagccatctcctgtgatctccttccgttcccaagctagctagcagacgcacaaggccgcggatccatgggcgtcttcacggtgaccaagctgtccgagggcccggtgcggccgtccgccgccacgccgtcggagacgctgcccatggcctgggtggaccggtacccgacgcaccgcggcctcgtcgagtccgcgcacatctaccgcaacgtcgccggcgacatctccccggcgccggcagggctagaggcggctggtggtggcgcgggcgccgatgccgccgcccccagactcgccctggaggcgccggacaaggaggcgatggtgaacggcaagtccccggccgcggtggtgcgcggcgctctggcggacgcgctggtgcactactacccgttcgcggggcggatcgaagaggacgtccccggccgccccgccgtgcggtgctccggcgagggcgtctacttcgtggaggccgccgccaactgcaccctcgccgacgtcaacttcctcgagcgcccgctgctgctcgccaaggagcagctcgtgccgtgcccgacgccggagctctggcccgtcgagccacacaacaccctcgccatgatacaggtcacgaccttcacctgcggcggcttcgtggtcggcctgcgcaccaaccacgcggtggcggacggcacgggcgcggcgcagttcctgaacgccgtcggc

SEQ ID NO: 51818 - protein, 457 aa, Panicum virgatum; identical to SEQ ID NO: 868
  misc_feature: Ceres CLONE 1886975
  misc_feature: Useful for making plants with altered cell wall content and/or composition

SEQ ID NO: 51819 - DNA, 2296 bp, Panicum virgatum
  misc_feature: Ceres CLONE 1902844
  misc_feature: Encodes the peptide sequence at SEQ ID NO. 51820
ctcggatcttcttccccttgcgcgtccgtgctcgcgcagtgctgctcttttttccccttcccgctgctccgtctcctcccttacccttgaagaagactcgagactctcccctcccctcctctaattggagagcaaggcagcaagcattgtattagtggatcccggaggtgccgccgctgcagggcccggtatgacatcgacggcctactcgcggcagccgaagctgccgggcggcggcggggagcggcggctgccgccccggctcatgcggggcctcgcgtccaagatcgagcccaagaagctcggcgtcggcctcgtcgccggctgctgcctcgcgctcctcacctacgtctccctcgccaagctcttcgcaatctactcccccgtgttcgcacggccaacacatccgccctgatgcagcagaactcgccgccgacggcgtccaagccgtccgttccggagacggaggcaatcccgccgcaggaaacactagctggcggcggcggcggcggaggcggaggcagcgccgtggatctgccggaggcgtcggggtccgaagagcccggcttgcccgatgctgtcacgagaaaggatatgccggtggcggcgggttccgatgagcccggcttgccggatgcgttgagaagaaaggacgacggcgagaatgcggcggcggcctcggagccaaagccatctgccaaggaaggggaagcaggggagcagaagcagaatggcgacgccgccgcggcggcggggggcgatggcaagatgacttgcgacgagaacggcgtggacgagggcttcccgtacgcgcgtccgaccgtgtgcgagctgtccggcgacatccgggtgagcccgaagcagaagaccgtgtacctggtgaacccgtcgggcggcggcgggttcgacgagggtggcgagaagcggctccggccgtacgcccgcaaggacgacttcctcctccccggcgtgacggaggtgactgtcaagtcgtccccgtccgcggcggtggcgccccggtgcacgaagcagcacgcggtgccggccgtgctcttctccgtcgccgggtacacggacaacttcttccacgacatgacggacgcgctggtcccgctgttcctgacggcggcgcacctcaagggcgaggtgcagctgctcatcaccgactacaagccgtggtgggtgcagaagtacacgccgctgctgcggaagctgtccaactacgcggcgatcaacttcgacgaggacgccggcgtgcactgcttccgggccgggttcgtgggcctgtaccgcgaccgcgacctgatcctgtccccgcacccgacgcgcaacccgcgcaactacaccatggtggacttcggccggttcgcgcgcgccgcgctggcgctgccgcgggaccggccggcggtgctcggcgaggagcccggcgcgcggccccggatgctgatcgtctcccgcgcggggacgcggcggctgctgaacctggaggcggtggcggcggcggcggcggagctcgggttcaacgtgacggcggcggaggccggcgcgaacgtgcctgcgttcgcggcgcaggtaaacgcggcggacgtgctgctggcggtgcacggcgcggggctgacgaaccagatcttcctgccggcgggggccgtggtggtgcagatcgtgccgtggggcaagatggactggatggcgaccaacttctacgggcggccggcggtgggcatggagctccggtacctggagtactacgtcggcgaggaggagacgagcctcaaggacaagtacccgcgggagcacacggtgttcagggaccccatggcgctccacaggcaggggtggcaggctctcgccgagatcgtcatgaagcaggacgtcagcgtcaacctcaccaggttccggcccgtcctgctgcaggcgctcgacaagctgcaggagtagtgggcgagctcggtcagcgaccaacccagccagccaaccggaacgagctgcagccgcccagcgcagtgaggggggcacacgtacgttcgcgtagacgagctgaagtgctaggaagaaagggaatcagggcaaggatccttcttgtccttgatggtagatccaagtgaggcggcttcatcaaattggtttgtgtcttggtttgtaacatcttggatagtgcactacatacactacacacggaaatgttatgttcattttttctgttttctgtccttcacttcacttggcattctagtagtgaagaaatggacccttttttcttcaaatgtgatcatactgtccataagttaatcgagcc

SEQ ID NO: 51820 - protein, 507 aa, Panicum virgatum
  misc_feature: Ceres CLONE 1902844
  misc_feature: Useful for making plants with altered cell wall content and/or composition
MQQNSPPTASKPSVPETEAIPPQETLAGGGGGGGGGSAVDLPEASGSEEPGLPDAVTRKDMPVAAGSDEPGLPDALRRKDDGENAAAASEPKPSAKEGEAGEQKQNGDAAAAAGGDGKMTCDENGVDEGFPYARPTVCELSGDIRVSPKQKTVYLVNPSGGGGFDEGGEKRLRPYARKDDFLLPGVTEVTVKSSPSAAVAPRCTKQHAVPAVLFSVAGYTDNFFHDMTDALVPLFLTAAHLKGEVQLLITDYKPWWVQKYTPLLRKLSNYAAINFDEDAGVHCFRAGFVGLYRDRDLILSPHPTRNPRNYTMVDFGRFARAALALPRDRPAVLGEEPGARPRMLIVSRAGTRRLLNLEAVAAAAAELGFNVTAAEAGANVPAFAAQVNAADVLLAVHGAGLTNQIFLPAGAVVVQIVPWGKMDWMATNFYGRPAVGMELRYLEYYVGEEETSLKDKYPREHTVFRDPMALHRQGWQALAEIVMKQDVSVNLTRFRPVLLQALDKLQE

SEQ ID NO: 51821 - DNA, 665 bp, Panicum virgatum
  misc_feature: Ceres CLONE 2040646
  misc_feature: Encodes the peptide sequence at SEQ ID NO. 51822
gtcctgcactcgatcgcctcgtccgtcgggaggtcttggatggtgcccgcatgacacatgggttcgattagagattacaagtggaagcgtatgggtaccaacgaagcatcccctcctactgttctctgcctcttctttctgttctgcttaggctgcaaatgcttagcgtcagaattcgaagccacccagacagcaaccctcaaggttgatgcctcaccgcagcttgctcggaagattcctgatacactatttgggatcttttttgaggagatcaaccatgcaggagctggtggaatatgggctgaactcgttagtaacagaggttttgaagctggaggccctcatactccatcaaacatcgacccatggtccatcattggagatgactcttccatatttgtggcgactgatcgtacatcatgtttcagtcgaaacattgttgctctaaggatggaggtcctctgtgatgactgtccagctgggggtgttggcatttacaacccaggattctggggcatgaacatagaagatggaaagacatacaacctagttatgtatgttaagtcaccagaaacaacagacttgacagtttcattaacgagtgccgatgggtcgcaaaatctggcttcagctacggtcacagtttctggcacgtcaaattggac

SEQ ID NO: 51822 - protein, 208 aa, Panicum virgatum
  misc_feature: Ceres CLONE 2040646
  misc_feature: Useful for making plants with altered cell wall content and/or composition
MGSIRDYKWKRMGTKEASPPTVLCLFFLFCLGCKCLASEFEATQTATLKVDASPQLARKIPDTLFGIFFEEINHAGAGGIWAELVSNRGFEAGGPHTPSNINPWSIIGDDSSIFVATDRTSCFSRNIVALRMEVLCDDGPAGGVGIYNPGFWGMNIEDGKTYNLVMYVKSPETTDLTVSLTSADGSQNLASATVTVSGTSNWTKLEQK

SEQ ID NO: 51823 - DNA, 646 bp, Panicum virgatum
  misc_feature: Ceres CLONE 1989132
  misc_feature: Encodes the peptide sequence at SEQ ID NO. 51824
aactccaatttcacttcacctcgacagcgcacaccccacccaccggtctccctcctccaccaccaccgaattagccaaggcacaggcggagcaggggggcctctcctctccttcccttcctcgccgccttcgcccggcgagccagccagccatggagccggcggcgaagacggtggagcggctggcgcagcgcctggtgccgccggcggagcccacgcccaccggcccgcaccgcctgtcctggctcgaccgctacccgacccagatggcgctcatcgagtcgctgcacgtcttcaagcccgacccggcgcgggacggggtcagccccgcggagaccatccagcgcgccctggcgcgggcgctcgtcgagtactacccgctcgcgggccgcctcgccgtgtccgacgccgccggggggctccacgtcgactgcagcggcgagggcgtctggttcgtcgaggccgccgttcggtgccggctcgaggacgtcgactacctcgagtacccgctgcagatccccaaggacgacctgctcccgcacccgctgccgcgccccacccgcgaggaggagaacaagctcatcctgctcgtccaggtacgcggggggctcctcgattcgagccgcattgtgcggggttgctccgat

SEQ ID NO: 51824 - protein, 176 aa, Panicum virgatum; identical to SEQ ID NO: 38770
  misc_feature: Ceres CLONE 1989132
  misc_feature: Useful for making plants with altered cell wall content and/or composition

SEQ ID NO: 51825 - DNA, 628 bp, Panicum virgatum
  misc_feature: Ceres CLONE 1998910
  misc_feature: Encodes the peptide sequence at SEQ ID NO. 51826
gtaaccgcgctgcacccgctccttttccctttcccttttttctcctcgtcttccttcccccgcccgctgctctcctcccctgcgtgcgagagagcaccagcagctcccgcttccaattccgccgcccccgcccccgtgcctctcctccattggctcgccgtcgccgcggccttgaccgcctcgcctcacccgtcgccaccggcatcgtcacctcctgtgctactccgtgccatcggggcctgacagggacggcctacccgcacagcggaggacggcgtcaggacaagcgctcccgagcaacaagtatcccggcagcgcttcgctgccgctcggcgctcgagctccacatacaccagcagcagcagcagcacgccagcacgagcggaagcgggagggagcgctagctgcttgattcggtcaactcctgcgcgctcgctgcaggatcaaggccaatggggcgggagaggaggccgtggccggcggcggccgccgccgttattctgctcgtcgcctcctgcgtcgccgcggcgccgctgcagcagcaccagcgcgccaggatcacaggtacgcgccgcccgcttcctcctcctcggttgtgaattcgctggatccggaaatgctctctcag

SEQ ID NO: 51826 - protein, 216 aa, Panicum virgatum
  misc_feature: Ceres CLONE 1998910
  misc_feature: Useful for making plants with altered cell wall content and/or composition
NRAFADWIGPGPGRPGRSPPFSCFRITPPAAGDPCNTALPPLLFPFPFFSSSSFPRPLLSSPACESTSSFRFQFRRPRRRASPPLARRRRGLDRLASPVATGLVTSCATPCHRGLTGTAYPHSGGRRQDKRSRATSIPAALRCRSALELHIHQQQQHASTSGSGRERWLLDSVNSRALAAGSRPMGRERRPWPAAAAAVLLLVASCVAAAPLQQHQ

SEQ ID NO: 51827 - DNA, 660 bp, Panicum virgatum
  misc_feature: Ceres CLONE 1993117
  misc_feature: Encodes the peptide sequence at SEQ ID NO. 51828
ctttttcccccgcccaccaaattgatagcccacctcacctcacctccgcacccgctgtttcgtgcgccgcacttctccccccacctacctctccccctcaaaaactatccgcctccgcccgccgacgagcgcgatcggtcgattcggttcgggccggccggagctcggaggggcggagcccagatccgggtgccggcggcgatgatgaagtcgctgctgccgcagagccagctgcggcgctcgtcggcgcggccgtcgggggccgccgccgccgcgggcggagacggggccgcggccgacggcggcggggccttggcgcgggcgcccgcctcgggcaccttctggttcctgctccacgcgctctgctgcctcatctcgctcttcctcgggttccgtttctcgcggctcctcttcttcctgctcttctccaccaccgcgctctaccactccaccacctcgtcctcctccgccgcggtcctgcgcgccaccacgacgaccacaaccaccacgaccacgacgacgaccaccaccaacatcttcacgctctccttcgcggcggcgaaccctccgccctccaaccccgccaaccgcaccgcgctggaggcggcctcggcggcggacaagggcgcgacctccgggaacccccagagccacgtgggg

SEQ ID NO: 51828 - protein, 220 aa, Panicum virgatum
  misc_feature: Ceres CLONE 1993117
  misc_feature: Useful for making plants with altered cell wall content and/or composition
LFPPPTKLIAHLTSPPHPLFRAPHFSPHLPLPLKNYPPPPADERDRSIRFGPAGARRGGAQIRVPAAMMKSLLPQSQLRRSSARPSGAAAAAGGDGAAADGGGALARAPASGTFWFLLHALCCLISLFLGFRFSRLLFFLLFSTTALYHSTTSSSSAAVLRATTTTTTTTTTTTTTTNIFTLSFAAANPPPSNPANRTALEAASAADKGATSGNPQSHVG

SEQ ID NO: 51829 - DNA, 1140 bp, Panicum virgatum
  misc_feature: Ceres CLONE 1726078
  misc_feature: Encodes the peptide sequence at SEQ ID NO. 51830
tctccaccccccctctcttctgacttctcctccacacaccagcccggccggccgcgcagggcacgcgtatgagcgaagcgagtgagccagcacgcagaagcaaacaagtggggaggtagagggacctcacagaccacatagggtgggagtggtgggaggaggargaggagtcaagagagcaagctcatacgcgcgtgcggcgacgtcgtacgtgggatgtcggcgtcggcgtcggcgtcgggcgtcgggcgccgcgtgtgcggtggcctggcggagtgcgcgtgccatgggcccgggatcggcggcgggcggtgcggggtcgctgtcgccgacctcaaccgcgggttcccggggatgtggcaccaggcggcggaggaggagcacggcgccgtcgtcggcggaggcgcagcggcggcggggctgcatgagttccagttcttcggccacgacgaggaccacgagagcgtgacgtggctgttcaacgaccctgcgccccacctgcagcgcgggccggcggcggccgcggtcggaaacggggtggccgaggccgagcagcggagggcgccgccgctgttcgacgggtacgcgcacgtgcagtacggccagatgccgggacacggcctcacgtttgacgtgccgctgagccggggcggcgaggcggccgccgcggcggtcctggaggccgggatggggctcggcggcggcggcggcagcaacccggcgacgtccagcgccacaatcacgcccttctgcggcgggagcacgttcactgacgcggcgagctccgtcgtcgtcccgggcgaggtcgctgcgacggggaacgggagcttgagcggcggcggcggggacccggcgatggaccgggaggcgaaggtgatgcggtacaaggagaagcggaagcggaggcgatacgagaagcagatccggtacgcctcgcgcaaggcctacgccgagatgcggccgcgcgtcaagggccggttcgccaaggtgcccgacggcgaggcgctggcgccaccggcggcggcggcgggctatgagcccggccggcggctcgacctcggatggtttcgttcatagccacgatcgatgtacctgacgtacgtttaattatataatgccggccggagcattagctagcac

SEQ ID NO: 51830 - protein, 286 aa, Panicum virgatum
  misc_feature: Ceres CLONE 1726078
  misc_feature: Useful for making plants with modulated flowering time
MSASASASGVGRRVCGGLAECACHGPGIGGGRCGVAVADLNRGFPGMWHQAAEEEHGAVVGGGAAAAGLHEFQFFGHDEDHESVTWLFNDPAPHLQRGPAAAAVGNGVAEAEQRRAPPLFDGYAHVQYGQMPGHGLTFDVPLSRGGEAAAAAVLEAGMGLGGGGGSNPATSSATITPFCGGSTFTDAASSVVVPGEVAATGNGSLSGGGGDPAMDREAKVMRYKEKRKRRRYEKQIRYASRKAYAEMRPRVKGRFAKVPDGEALAPPAAAAGYEPGRRLDLGWFRS

SEQ ID NO: 51831 - DNA, 1913 bp, Panicum virgatum; identical to SEQ ID NO: 19937
  misc_feature: Ceres CLONE 1807658
  misc_feature: Encodes the peptide sequence at SEQ ID NO. 51832

SEQ ID NO: 51832 - protein, 519 aa, Panicum virgatum; identical to SEQ ID NO: 19938
  misc_feature: Ceres CLONE 1807658
  misc_feature: Useful for making plants with altered cell wall content and/or composition

SEQ ID NO: 51833 - DNA, 1215 bp, Panicum virgatum; identical to SEQ ID NO: 51789
  misc_feature: Ceres CLONE 1985706
  misc_feature: Encodes the peptide sequence at SEQ ID NO. 51834

SEQ ID NO: 51834 - protein, 369 aa, Panicum virgatum
  misc_feature: Ceres CLONE 1985706
  misc_feature: Useful for making plants with altered cell wall content and/or composition
MASSTAYSRPSKPPGPAAGDRRGPRLAKELGKIEPKKLGIGLVAGCCLALLTYLSFARLFAIYSPVFDSSALVLRNAPPATTTVPATEAPPVEQKTEVEEQKDVTDPEADPNMTNLPEVTRKDEQEDSAATKPASAATEAKITCDENGVDEGFPYARPPVCELTGDIRISPKEKTMYLVNPSGAGPFDANGEKKIRPFARKDDFLLPGVVEVTIKSVSSAEAAPQCTRRHDVPVVVFSVAGYTDNFFHDNTDVLIPLFLTTAHLKGEVQLLITNFKPWWVHKFTPLLKKLSNYDVINFDKDEGVHCFRAGHLGMYRDRDLIISPHPTRNPHNYSMVDYNRFLRRAFALPRDAPAVLGEETSAKPKMLII

SEQ ID NO: 51835 - DNA, 1545 bp, Panicum virgatum; identical to SEQ ID NO: 21290
  misc_feature: Ceres CLONE 1815457
  misc_feature: Encodes the peptide sequence at SEQ ID NO. 51836

SEQ ID NO: 51836 - protein, 243 aa, Panicum virgatum; identical to SEQ ID NO: 21291
  misc_feature: Ceres CLONE 1815457
  misc_feature: Useful for making plants with altered cell wall content and/or composition

SEQ ID NO: 51837 - DNA, 1947 bp, Panicum virgatum; identical to SEQ ID NO: 30434
  misc_feature: Ceres CLONE 1900121
  misc_feature: Encodes the peptide sequence at SEQ ID NO. 51838

SEQ ID NO: 51838 - protein, 480 aa, Panicum virgatum; identical to SEQ ID NO: 30435
  misc_feature: Ceres CLONE 1900121
  misc_feature: Useful for making plants with altered cell wall content and/or composition

SEQ ID NO: 51839 - DNA, 1748 bp, Panicum virgatum
  misc_feature: Ceres CLONE 1796420
  misc_feature: Encodes the peptide sequence at SEQ ID NO. 51840
acagctgtatccagatgagaatatacagcaaaaaaaaaaaactctaaaccccagcgccggctgcaatctcacccaccgccgacggcgagatctccaggatggccttagccgggcggcgggacggccccctcatgctacggggcggcggcggcgggaaacccctgtcgcatgggtctcggatcgcggtggcggtcgctgtcggcatcgcgctcggctgcgtctgcgccttcctctaccccgacggcctcttccgcccgtctgcctctgccctccaatggtcgcgccacgttgactcaactgcttgcgaatcatcagggcgagttaccaaccttgagtcccagttggcatcattggagagaaagaatgctgaactgaggaggcagattaatgaattatccatgaaacttcaattggctggacaaggaaaagatgagaccttgtacaaggctggtccttttggaactgtcaaggctttgagaacaaatccaacagtaatgcctgatgaatctgttaattccaggctggccaagatactgggagaggttgctgtcaagaaagaacttattgttgcattggcaaattctaacgttagggagatgcttgaagtttggtttaccaatatcaaacaagttggtgttccaaacttcctagttgtggcattggatgacaatatagaaagcttctgcaaatctaacggtgttccggtctaccggcgtgatcctgatgaaggtatcgacaacattgcaaaaacgggtgggaaccatgccgtttctggactaaagtttcgtgttttaagggagttcttgcagcttggatatagtattctcctctctgacattgatattattttcctgaggaacccattcgatcacctttacagagattctgatgtagagtccatgagtgatggccacaacaacatgacagcttatggcttcaacgatgtgtttgatgagccatctatgggctgggccagatatgcacacacaatgcggatctgggtttacaactccggctttttctatataagaccaacaattccttcgattgaacttctggatcgagtagctgaccgcctttctcatgagaaggcatgggaccaagcagtcttcaacgaggaactgttcttcccatctcatccaggttatgaaggcctttatgcgtccagaagaaccatggatatttatctattcatgaacagcaaagttctcttcaagactgtgaggaaagacgctcagctcaagaagctaaagccagtgattgtgcatttgaactaccatccagacaagttagaccggatgaaagctgttattgaattctatgtgaatggaaagcaagatgcgctgcaacgtttccctgacggatctgaatgaggaaattgcagatttttctggtacagaaatatacactcgtcatatccttgtggttgtgtggtcgtcatatcaaagcgtgaatgtttgatgatctgagtgccatatggatccgttgagcttgagctatttggacgtcactttagtctctactaacctcaacagttctgtagcaaacatggagtagcttagatggctgatcacatttttctttttaatctgagttgttgacattggaatttcgaagccgtggtggttgccatgtactcaggctaccagcgacatgctttgatgctggtgtttccttgtatcgtggtttgctcgagagtttgagaaccaattacagttttgatgatacgaattcgatatttatccgcg

SEQ ID NO: 51840 - protein, 424 aa, Panicum virgatum
  misc_feature: Ceres CLONE 1796420
  misc_feature: Useful for making plants with altered cell wall content and/or composition
MALAGRRDGPLMLRGGGGGKPLSHGSRIAVAVAVGIALGCVCAFLYPDGLFRPSASALQWSRHVDSTACESSGRVTNLESQLASLERKNAELRRQINELSMKLQLAGQGKDETLYKAGPFGTVKALRTNPTVMPDESVNSRLAKILGEVAVKKELIVALANSNVREMLEVWFTNIKQVGVPNFLVVALDDNIESFCKSNGVPVYRRDPDEGIDNIAKTGGNHAVSGLKFRVLREFLQLGYSILLSDIDIIFLRNPFDHLYRDSDVESMSDGHNNMTAYGFNDVFDEPSMGWARYAHTMRIWVYNSGFFYIRPTIPSIELLDRVADRLSHEKAWDQAVFNEELFFPSHPGYEGLYASRRTMDIYLFMNSKVLFKTVRKDAQLKKLKPVIVHLNYHPDKLDRMKAVIEFYVNGKQDALQRFPDGSE

SEQ ID NO: 51841 - DNA, 720 bp, Panicum virgatum; identical to SEQ ID NO: 26506
  misc_feature: Ceres CLONE 1870304
  misc_feature: Encodes the peptide sequence at SEQ ID NO. 51842

SEQ ID NO: 51842 - protein, 175 aa, Panicum virgatum
  misc_feature: Ceres CLONE 1870304
  misc_feature: Useful for making plants with modulated water use efficiency
  misc_feature: Useful for making plants with modulated drought sensitivity
MADAPASPGGGGGSHESGSPRGGAGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKTGDGSIKKDALGHGGASSSATQGMGQQGAYNQGMGYMQPQYHN

SEQ ID NO: 51843 - DNA, 831 bp, Panicum virgatum
  misc_feature: Ceres CLONE 11684
  misc_feature: Encodes the peptide sequence at SEQ ID NO. 51844
aggcccatattccattcttacctctctctacctctctatctctctctcctcataatcgatccgtaaactcgccggaggagcagggagattcaataagacgatggctcagagaacggagaaggaagagaccgagttcaaagttctcgaaaccttgacgacaacaacaacgacgttatgtaccaataactgcggcgttacagcgaatcctgcgacgaacaacatgtgtcagaaatgtttcaacgcatctctcgtctcggcggccgcaggtgttgttgaatcaggttcgatcttgaagagatcggctagatctgtcaatcttcgttcgtcaccagctaaagtcgtgattcgtccaagagagatcgatgcggtgaagaagagagatcaacagatcgtaaaccgatgttctggttgtcggaagaaagttgggttgaccggattcaggtgccgatgcggtgagcttttctgctcagagcaccgttactccgatcgtcatgattgtagctacgactacaaaaccgctggtcgtgaggcgatcgctagagaaaatccggtggtcaaggctgcgaaaatggtcaaagtttaaaaaattaaaaattcgatctcaaccgttgaaaaacttgtggtggttcaaaagctccgatcggaagagagattggtcggagagacatggatttgatttggtgatgtgttgtaaaagaagatcagagagattattcctctcctcaaatcaaaatctgaacctcaattttttttttttacgtttttttttcatcttttaatttatatattagtgaatgattattaatattattattgtgtggcttacggatt

SEQ ID NO: 51844 - protein, 160 aa, Panicum virgatum; identical to SEQ ID NO: 51279
  misc_feature: Ceres CLONE 11684
  misc_feature: Useful for making plants with modulated water use efficiency
  misc_feature: Useful for making plants with modulated drought sensitivity

SEQ ID NO: 51845 - DNA, 718 bp, Panicum virgatum
  misc_feature: Encodes the peptide sequence at SEQ ID NO. 51846
atcatgcttgagcactctctcacacactactacctccctatcttataacgcgatcgatcgaccctgattaaaggtagccaggtgatcatcttatcactctagggaggagttaaataaaaattaaaggaaggtgcggctacgttgaagtggccggccggccggtgagctacctagggagcgagcgagcatgggtaccatcgggttcccggtgacgaacaggatcaggtcgctggtggcgacgtcgtacggcgacgccgcacgagacgctgcggctgtaggtgatcgaccgcgtggcggggctgcggcacctggtgcggtcgctgaacgtgttcgacggccggcgcggcggggaggcggtggtgaataataataacacgccggcgccggcaccggccgatacggcgcgggaggcgctggggaatgctctggtggactactacccgttggcagggcggtgcgaggaggatgaccgggaggtgcaggtgtcgtgcacggcggatggatcgtggttcttgtaggcggatgatgaatgcactctgtacgaggtgaatcatcaggaccaacacatgctcatatccaatgaggacctgctgcctgagccgtcggcgcctgacctccacgccctcgacatgctgctcatgatgcacgtgaccgagttcgcgagcagtggcttcttgatgactctctctccatgcacaccatcggagacagactcggc

SEQ ID NO: 51846 - protein, 59 aa, Panicum virgatum
  misc_feature: Useful for making plants with altered cell wall content and/or composition
MGTIGFPVTNRIRSLVATSYGDAARDAAAVGDRPRGGAAAPGAVAERVRRPARRGGGGE
